(12) United States Patent
Ecker et al.

(10) Patent No.: US 8,057,993 B2
(45) Date of Patent: Nov. 15, 2011

US008057993B2

(54) METHODS FOR IDENTIFICATION OF CORONAVIRUSES

(75) Inventors: David J. Ecker, Encinitas, CA (US); Steven A. Hofstadler, Oceanside, CA (US); Rangarajan Sampath, San Diego, CA (US); Lawrence B. Blyn, Mission Viejo, CA (US); Thomas A. Hall, Oceanside, CA (US); Christian Massire, Carlsbad, CA (US)

(73) Assignee: Ibis Biosciences, Inc., Carlsbad, CA (US)

( * ) Notice: Subject to any disclaimer, the term of this patent is extended or adjusted under 35 U.S.C. 154(b) by 531 days.

(21) Appl. No.: 10/829,826

(22) Filed: Apr. 22, 2004

(65) Prior Publication Data

US 2005/0266397 A1 Dec. 1, 2005

Related U.S. Application Data

(60) Provisional application No. 60/466,009, filed on Apr. 26, 2003, provisional application No. 60/467,768, filed on May 2, 2003, provisional application No. 60/468,743, filed on May 7, 2003, provisional application No. 60/542,510, filed on Feb. 6, 2004.

(51) Int. Cl.
*C12Q 1/68* (2006.01)
*C07H 21/04* (2006.01)
*C12P 19/34* (2006.01)
*G01N 24/00* (2006.01)

(52) U.S. Cl. ......... 435/6; 435/91.1; 536/23.1; 536/24.3; 436/173

(58) Field of Classification Search .................. None
See application file for complete search history.

(56) References Cited

U.S. PATENT DOCUMENTS

| | | | |
|---|---|---|---|
| 4,075,475 A | 2/1978 | Risby et al. |
| 4,683,195 A | 7/1987 | Mullis et al. |
| 4,683,202 A | 7/1987 | Mullis |
| 4,965,188 A | 10/1990 | Mullis et al. |
| 5,015,845 A | 5/1991 | Allen et al. |
| 5,072,115 A | 12/1991 | Zhou |
| 5,143,905 A | 9/1992 | Sivasubramanian et al. |
| 5,213,961 A | 5/1993 | Bunn et al. |
| 5,219,727 A | 6/1993 | Wang et al. |
| 5,288,611 A | 2/1994 | Kohne |
| 5,436,129 A | 7/1995 | Stapleton |
| 5,451,500 A | 9/1995 | Stapleton |
| 5,472,843 A | 12/1995 | Milliman |
| 5,476,774 A | 12/1995 | Wang et al. |
| 5,484,908 A | 1/1996 | Froehler et al. |
| 5,502,177 A | 3/1996 | Matteucci et al. |
| 5,503,980 A | 4/1996 | Cantor |
| 5,504,327 A | 4/1996 | Sproch et al. |
| 5,504,329 A | 4/1996 | Mann et al. |
| 5,523,217 A | 6/1996 | Lupski et al. |
| 5,527,669 A | 6/1996 | Resnick et al. |
| 5,527,675 A | 6/1996 | Coull et al. |
| 5,541,308 A * | 7/1996 | Hogan et al. ................. 536/23.1 |
| 5,547,835 A | 8/1996 | Koster |
| 5,567,587 A | 10/1996 | Kohne |
| 5,576,204 A | 11/1996 | Blanco et al. |
| 5,580,733 A | 12/1996 | Levis et al. |
| 5,605,798 A | 2/1997 | Koster |
| 5,608,217 A | 3/1997 | Franzen et al. |
| 5,612,179 A | 3/1997 | Simons |
| 5,622,824 A | 4/1997 | Koster |
| 5,625,184 A | 4/1997 | Vestal et al. |
| 5,639,606 A | 6/1997 | Willey |
| 5,641,632 A | 6/1997 | Kohne |
| 5,645,985 A | 7/1997 | Froehler et al. |
| 5,683,869 A | 11/1997 | Ramsay Shaw et al. |
| 5,686,242 A | 11/1997 | Bruice et al. |
| 5,691,141 A | 11/1997 | Koster |
| 5,700,642 A | 12/1997 | Monforte et al. |
| 5,702,895 A | 12/1997 | Matsunaga et al. |
| 5,707,802 A | 1/1998 | Sandhu et al. |
| 5,712,125 A | 1/1998 | Uhlen |
| 5,716,825 A | 2/1998 | Hancock et al. |
| 5,727,202 A | 3/1998 | Kucala |
| 5,745,751 A | 4/1998 | Nelson et al. |
| 5,747,246 A | 5/1998 | Pannetier et al. |
| 5,747,251 A | 5/1998 | Carson et al. |
| 5,753,467 A | 5/1998 | Jensen et al. |
| 5,753,489 A | 5/1998 | Kistner et al. |
| 5,759,771 A | 6/1998 | Tilanus |
| 5,763,169 A | 6/1998 | Sandhu et al. |
| 5,763,588 A | 6/1998 | Matteucci et al. |
| 5,770,367 A | 6/1998 | Southern et al. |

(Continued)

FOREIGN PATENT DOCUMENTS

CA 2492333 A1 2/2004

(Continued)

OTHER PUBLICATIONS

Thiel et al. (J. Gen. Virology 2001 82:1273-1281).*
Buck (Biotechniques (1999) 27(3):528-536).*
van Dinten et al. (J. Virology, 1999, vol. 73, pp. 2027-2037).*
Snijder et al. J. General Virology, 1998, vol. 79, pp. 961-979.*
U.S. Appl. No. 09/798,007, filed Mar. 2, 2001, Ecker et al.
U.S. Appl. No. 09/891,793, filed Jun. 26, 2001, Ecker et al.
U.S. Appl. No. 10/156,608, filed May 24, 2002, Ecker et al.
U.S. Appl. No. 10/318,463, filed Dec. 13, 2002, Ecker et al.
U.S. Appl. No. 10/318,881, filed Dec. 13, 2002, Ecker et al.
U.S. Appl. No. 10/319,290, filed Dec. 13, 2002, Ecker et al.
U.S. Appl. No. 10/319,342, filed Dec. 13, 2002, Ecker et al.

(Continued)

*Primary Examiner* — Sarae Bausch
(74) *Attorney, Agent, or Firm* — Casimir Jones S.C.; Christopher C. Sappenfield

(57) ABSTRACT

The present invention provides a method for rapid identification and quantitation of bacteria by amplification of a segment of bacterial nucleic acid followed by analysis by mass spectrometry. The compositions provide for characterization of the molecular masses and base compositions of bacterial nucleic acids which are used to rapidly identify bacteria.

7 Claims, 22 Drawing Sheets

U.S. PATENT DOCUMENTS

| | | |
|---|---|---|
| 5,777,324 A | 7/1998 | Hillenkamp |
| 5,814,442 A | 9/1998 | Natarajan et al. |
| 5,822,824 A | 10/1998 | Dion |
| 5,828,062 A | 10/1998 | Jarrell et al. |
| 5,830,653 A | 11/1998 | Froehler et al. |
| 5,830,655 A | 11/1998 | Monforte et al. |
| 5,830,853 A | 11/1998 | Backstrom et al. |
| 5,832,489 A | 11/1998 | Kucala |
| 5,834,255 A | 11/1998 | Van Gemen et al. |
| 5,845,174 A | 12/1998 | Yasui et al. |
| 5,849,492 A | 12/1998 | Rogan |
| 5,849,497 A | 12/1998 | Steinman |
| 5,849,901 A | 12/1998 | Mabilat et al. |
| 5,851,765 A | 12/1998 | Koster |
| 5,856,174 A | 1/1999 | Lipshutz et al. |
| 5,864,137 A | 1/1999 | Becker et al. |
| 5,866,429 A | 2/1999 | Bloch |
| 5,869,242 A | 2/1999 | Kamb |
| 5,871,697 A | 2/1999 | Rothberg et al. |
| 5,872,003 A | 2/1999 | Koster |
| 5,876,936 A | 3/1999 | Ju |
| 5,876,938 A | 3/1999 | Stolowitz et al. |
| 5,885,775 A | 3/1999 | Haff et al. |
| 5,900,481 A | 5/1999 | Lough et al. |
| 5,928,905 A | 7/1999 | Stemmer et al. |
| 5,928,906 A | 7/1999 | Koster et al. |
| 5,965,363 A | 10/1999 | Monforte et al. |
| 5,965,383 A | 10/1999 | Vogel et al. |
| 5,972,693 A | 10/1999 | Rothberg et al. |
| 5,976,798 A | 11/1999 | Parker et al. |
| 5,981,176 A | 11/1999 | Wallace |
| 5,981,190 A | 11/1999 | Israel |
| 5,994,066 A | 11/1999 | Bergeron et al. |
| 6,001,564 A | 12/1999 | Bergeron et al. |
| 6,005,096 A | 12/1999 | Matteucci et al. |
| 6,007,690 A | 12/1999 | Nelson et al. |
| 6,007,992 A | 12/1999 | Lin et al. |
| 6,015,666 A | 1/2000 | Springer et al. |
| 6,018,713 A | 1/2000 | Coli et al. |
| 6,024,925 A | 2/2000 | Little et al. |
| 6,028,183 A | 2/2000 | Lin et al. |
| 6,043,031 A | 3/2000 | Koster et al. |
| 6,046,005 A | 4/2000 | Ju et al. |
| 6,051,378 A | 4/2000 | Monforte et al. |
| 6,054,278 A | 4/2000 | Dodge et al. |
| 6,055,487 A | 4/2000 | Margery et al. |
| 6,060,246 A | 5/2000 | Summerton et al. |
| 6,061,686 A | 5/2000 | Gauvin et al. |
| 6,063,031 A | 5/2000 | Cundari et al. |
| 6,074,823 A | 6/2000 | Koster |
| 6,074,831 A | 6/2000 | Yakhini et al. |
| 6,090,558 A | 7/2000 | Butler et al. |
| 6,104,028 A | 8/2000 | Hunter et al. |
| 6,110,710 A | 8/2000 | Smith et al. |
| 6,111,251 A | 8/2000 | Hillenkamp |
| 6,133,436 A | 10/2000 | Koster et al. |
| 6,140,053 A | 10/2000 | Koster |
| 6,146,144 A | 11/2000 | Fowler et al. |
| 6,146,854 A | 11/2000 | Koster et al. |
| 6,153,389 A | 11/2000 | Haarer et al. |
| 6,159,681 A | 12/2000 | Zebala |
| 6,180,339 B1 | 1/2001 | Sandhu et al. |
| 6,180,372 B1 | 1/2001 | Franzen |
| 6,187,842 B1 | 2/2001 | Kobayashi et al. |
| 6,194,144 B1 | 2/2001 | Koster |
| 6,214,555 B1 | 4/2001 | Leushner et al. |
| 6,218,118 B1 | 4/2001 | Sampson et al. |
| 6,221,587 B1 | 4/2001 | Ecker et al. |
| 6,221,598 B1 | 4/2001 | Schumm et al. |
| 6,221,601 B1 | 4/2001 | Koster |
| 6,221,605 B1 | 4/2001 | Koster |
| 6,225,450 B1 | 5/2001 | Koster |
| 6,235,476 B1 | 5/2001 | Bergmann et al. |
| 6,235,478 B1 | 5/2001 | Koster |
| 6,235,480 B1 | 5/2001 | Shultz et al. |
| 6,238,871 B1 | 5/2001 | Koster |
| 6,238,927 B1 | 5/2001 | Abrams et al. |
| 6,239,159 B1 | 5/2001 | Brown et al. |
| 6,258,538 B1 | 7/2001 | Koster et al. |
| 6,261,769 B1 | 7/2001 | Everett et al. |
| 6,265,716 B1 | 7/2001 | Hunter et al. |
| 6,265,718 B1 | 7/2001 | Park et al. |
| 6,266,131 B1 | 7/2001 | Hamada et al. |
| 6,266,144 B1 | 7/2001 | Li |
| 6,268,129 B1 | 7/2001 | Gut et al. |
| 6,268,131 B1 | 7/2001 | Kang et al. |
| 6,268,144 B1 | 7/2001 | Koster |
| 6,268,146 B1 | 7/2001 | Shultz et al. |
| 6,270,973 B1 | 8/2001 | Lewis et al. |
| 6,270,974 B1 | 8/2001 | Shultz et al. |
| 6,274,726 B1 | 8/2001 | Laugharn, Jr. et al. |
| 6,277,573 B1 | 8/2001 | Koster |
| 6,277,578 B1 | 8/2001 | Shultz et al. |
| 6,277,634 B1 | 8/2001 | McCall et al. |
| 6,300,076 B1 | 10/2001 | Koster |
| 6,303,297 B1 | 10/2001 | Lincoln et al. |
| 6,312,893 B1 | 11/2001 | Van Ness et al. |
| 6,312,902 B1 | 11/2001 | Shultz et al. |
| 6,322,970 B1 | 11/2001 | Little et al. |
| 6,361,940 B1 | 3/2002 | Van Ness et al. |
| 6,372,424 B1 | 4/2002 | Brow et al. |
| 6,389,428 B1 | 5/2002 | Rigault et al. |
| 6,391,551 B1 | 5/2002 | Shultz et al. |
| 6,393,367 B1 | 5/2002 | Tang et al. |
| 6,419,932 B1 | 7/2002 | Dale |
| 6,423,966 B2 | 7/2002 | Hillenkamp et al. |
| 6,428,955 B1 | 8/2002 | Koster et al. |
| 6,428,956 B1 | 8/2002 | Crooke et al. |
| 6,432,651 B1 | 8/2002 | Hughes et al. |
| 6,436,635 B1 | 8/2002 | Fu et al. |
| 6,436,640 B1 | 8/2002 | Simmons et al. |
| 6,453,244 B1 | 9/2002 | Oefner |
| 6,458,533 B1 | 10/2002 | Felder et al. |
| 6,468,743 B1 | 10/2002 | Romick et al. |
| 6,468,748 B1 | 10/2002 | Monforte et al. |
| 6,475,143 B2 | 11/2002 | Iliff |
| 6,475,736 B1 | 11/2002 | Stanton, Jr. |
| 6,475,738 B2 | 11/2002 | Shuber et al. |
| 6,479,239 B1 | 11/2002 | Anderson et al. |
| 6,500,621 B2 | 12/2002 | Koster |
| 6,553,317 B1 | 4/2003 | Ament et al. |
| 6,558,902 B1 | 5/2003 | Hillenkamp |
| 6,563,025 B1 | 5/2003 | Song et al. |
| 6,566,055 B1 | 5/2003 | Monforte et al. |
| 6,568,055 B1 | 5/2003 | Tang et al. |
| 6,582,916 B1 | 6/2003 | Schmidt et al. |
| 6,586,584 B2 | 7/2003 | McMillian et al. |
| 6,589,485 B2 | 7/2003 | Koster |
| 6,602,662 B1 | 8/2003 | Koster et al. |
| 6,605,433 B1 | 8/2003 | Fliss et al. |
| 6,610,492 B1 * | 8/2003 | Stanton et al. .................. 435/6 |
| 6,613,509 B1 | 9/2003 | Chen |
| 6,613,520 B2 | 9/2003 | Ashby |
| 6,623,928 B2 | 9/2003 | Van Ness et al. |
| 6,638,714 B1 | 10/2003 | Linnen et al. |
| 6,680,476 B1 | 1/2004 | Hidalgo et al. |
| 6,682,889 B1 | 1/2004 | Wang |
| 6,705,530 B2 | 3/2004 | Kiekhaefer |
| 6,706,530 B2 | 3/2004 | Hillenkamp |
| 6,783,939 B2 | 8/2004 | Olmsted et al. |
| 6,800,289 B2 | 10/2004 | Nagata et al. |
| 6,813,615 B1 | 11/2004 | Colasanti et al. |
| 6,836,742 B2 | 12/2004 | Brekenfeld |
| 6,852,487 B1 | 2/2005 | Barany et al. |
| 6,856,914 B1 | 2/2005 | Pelech |
| 6,875,593 B2 | 4/2005 | Froehler |
| 6,906,316 B2 | 6/2005 | Sugiyama et al. |
| 6,906,319 B2 | 6/2005 | Hoyes |
| 6,914,137 B2 | 7/2005 | Baker |
| 6,977,148 B2 | 12/2005 | Dean et al. |
| 6,994,962 B1 | 2/2006 | Thilly |
| 7,022,835 B1 | 4/2006 | Rauth et al. |
| 7,024,370 B2 | 4/2006 | Epler et al. |
| 7,108,974 B2 | 9/2006 | Ecker et al. |
| 7,198,893 B1 | 4/2007 | Köster et al. |
| 7,217,510 B2 | 5/2007 | Ecker et al. |
| 7,226,739 B2 | 6/2007 | Ecker et al. |

| | | | |
|---|---|---|---|
| 7,255,992 B2 | 8/2007 | Ecker et al. |
| 7,285,422 B1 | 10/2007 | Little et al. |
| 7,312,036 B2 | 12/2007 | Sampath et al. |
| 7,321,828 B2 | 1/2008 | Cowsert et al. |
| 7,349,808 B1 | 3/2008 | Kreiswirth et al. |
| 7,390,458 B2 | 6/2008 | Burow et al. |
| 7,419,787 B2 | 9/2008 | Köster |
| 7,501,251 B2 | 3/2009 | Köster et al. |
| 7,666,588 B2 | 2/2010 | Ecker et al. |
| 7,718,354 B2 | 5/2010 | Ecker et al. |
| 7,741,036 B2 | 6/2010 | Ecker et al. |
| 7,781,162 B2 | 8/2010 | Ecker et al. |
| 2001/0039263 A1 | 11/2001 | Matthes et al. |
| 2002/0006611 A1 | 1/2002 | Portugal et al. |
| 2002/0042112 A1 | 4/2002 | Koster et al. |
| 2002/0042506 A1 | 4/2002 | Kristyanne et al. |
| 2002/0045178 A1 | 4/2002 | Cantor et al. |
| 2002/0055101 A1 | 5/2002 | Bergeron et al. |
| 2002/0120408 A1 | 8/2002 | Kreiswirth et al. |
| 2002/0137057 A1 | 9/2002 | Wold et al. |
| 2002/0138210 A1 | 9/2002 | Wilkes et al. |
| 2002/0150903 A1 | 10/2002 | Koster |
| 2002/0150927 A1 | 10/2002 | Matray et al. |
| 2002/0168630 A1 | 11/2002 | Fleming et al. |
| 2002/0187490 A1 | 12/2002 | Tiedje et al. |
| 2003/0017487 A1 | 1/2003 | Xue |
| 2003/0027135 A1 | 2/2003 | Ecker et al. |
| 2003/0039976 A1 | 2/2003 | Haff |
| 2003/0050470 A1 | 3/2003 | An et al. |
| 2003/0064483 A1 | 4/2003 | Shaw et al. |
| 2003/0073112 A1 | 4/2003 | Zhang et al. |
| 2003/0084483 A1 | 5/2003 | Simpson et al. |
| 2003/0101172 A1 | 5/2003 | De La Huerga |
| 2003/0104410 A1 | 6/2003 | Mittmann |
| 2003/0104699 A1 | 6/2003 | Minamihaba et al. |
| 2003/0113738 A1 | 6/2003 | Liu et al. |
| 2003/0113745 A1 | 6/2003 | Monforte et al. |
| 2003/0119018 A1 | 6/2003 | Omura et al. |
| 2003/0129589 A1 | 7/2003 | Koster et al. |
| 2003/0134312 A1 | 7/2003 | Burgoyne |
| 2003/0148281 A1 | 8/2003 | Glucksmann |
| 2003/0148284 A1 | 8/2003 | Vision et al. |
| 2003/0167133 A1 | 9/2003 | Ecker et al. |
| 2003/0167134 A1 | 9/2003 | Ecker et al. |
| 2003/0175695 A1 | 9/2003 | Ecker et al. |
| 2003/0175696 A1 | 9/2003 | Ecker et al. |
| 2003/0175697 A1 | 9/2003 | Ecker et al. |
| 2003/0175729 A1 | 9/2003 | Van Eijk et al. |
| 2003/0186247 A1 | 10/2003 | Smarason et al. |
| 2003/0187588 A1 | 10/2003 | Ecker et al. |
| 2003/0187593 A1 | 10/2003 | Ecker et al. |
| 2003/0190605 A1 | 10/2003 | Ecker et al. |
| 2003/0190635 A1 | 10/2003 | McSwiggen |
| 2003/0194699 A1 | 10/2003 | Lewis et al. |
| 2003/0203398 A1 | 10/2003 | Bramucci et al. |
| 2003/0220844 A1 | 11/2003 | Marnellos et al. |
| 2003/0224377 A1 | 12/2003 | Wengel et al. |
| 2003/0225529 A1 | 12/2003 | Ecker et al. |
| 2003/0228571 A1 | 12/2003 | Ecker et al. |
| 2003/0228597 A1 | 12/2003 | Cowsert et al. |
| 2003/0228613 A1 | 12/2003 | Bornarth et al. |
| 2004/0005555 A1 | 1/2004 | Rothman et al. |
| 2004/0013703 A1 | 1/2004 | Ralph et al. |
| 2004/0014957 A1 | 1/2004 | Eldrup et al. |
| 2004/0023207 A1 | 2/2004 | Polansky |
| 2004/0023209 A1 | 2/2004 | Jonasson |
| 2004/0029129 A1 | 2/2004 | Wang et al. |
| 2004/0038206 A1 | 2/2004 | Zhang et al. |
| 2004/0038208 A1 | 2/2004 | Fisher et al. |
| 2004/0038234 A1 | 2/2004 | Gut et al. |
| 2004/0038385 A1 | 2/2004 | Langlois et al. |
| 2004/0081993 A1 | 4/2004 | Cantor et al. |
| 2004/0101809 A1 | 5/2004 | Weiss et al. |
| 2004/0110169 A1 | 6/2004 | Ecker et al. |
| 2004/0111221 A1 | 6/2004 | Beattie et al. |
| 2004/0117129 A1 | 6/2004 | Ecker et al. |
| 2004/0117354 A1 | 6/2004 | Azzaro et al. |
| 2004/0121309 A1 | 6/2004 | Ecker et al. |
| 2004/0121310 A1 | 6/2004 | Ecker et al. |
| 2004/0121311 A1 | 6/2004 | Ecker et al. |
| 2004/0121312 A1 | 6/2004 | Ecker et al. |
| 2004/0121313 A1 | 6/2004 | Ecker et al. |
| 2004/0121314 A1 | 6/2004 | Ecker et al. |
| 2004/0121315 A1 | 6/2004 | Ecker et al. |
| 2004/0121329 A1 | 6/2004 | Ecker et al. |
| 2004/0121335 A1 | 6/2004 | Ecker et al. |
| 2004/0121340 A1 | 6/2004 | Ecker et al. |
| 2004/0122598 A1 | 6/2004 | Ecker et al. |
| 2004/0122857 A1 | 6/2004 | Ecker et al. |
| 2004/0126764 A1 | 7/2004 | Lasken et al. |
| 2004/0137013 A1 | 7/2004 | Katinger et al. |
| 2004/0185438 A1 | 9/2004 | Ecker |
| 2004/0191769 A1 | 9/2004 | Marino et al. |
| 2004/0202997 A1 | 10/2004 | Ecker et al. |
| 2004/0206260 A1 | 10/2004 | Pitz et al. |
| 2004/0220844 A1 | 11/2004 | Sanville et al. |
| 2004/0253583 A1 | 12/2004 | Ecker et al. |
| 2004/0253619 A1 | 12/2004 | Ecker et al. |
| 2005/0026147 A1 | 2/2005 | Walker et al. |
| 2005/0026641 A1 | 2/2005 | Hokao |
| 2005/0027459 A1 | 2/2005 | Ecker et al. |
| 2005/0065813 A1 | 3/2005 | Mishelevich et al. |
| 2005/0130196 A1 | 6/2005 | Hofstadler et al. |
| 2005/0130216 A1 | 6/2005 | Becker et al. |
| 2005/0142584 A1 | 6/2005 | Willson et al. |
| 2005/0250125 A1 | 11/2005 | Novakoff |
| 2005/0266411 A1 | 12/2005 | Hofstadler et al. |
| 2006/0020391 A1 | 1/2006 | Kreiswirth et al. |
| 2006/0121520 A1 | 6/2006 | Ecker et al. |
| 2006/0172330 A1 | 8/2006 | Osborn et al. |
| 2006/0205040 A1 | 9/2006 | Sampath |
| 2006/0240412 A1 | 10/2006 | Hall et al. |
| 2006/0259249 A1 | 11/2006 | Sampath et al. |
| 2007/0218467 A1 | 9/2007 | Ecker et al. |
| 2008/0160512 A1 | 7/2008 | Ecker et al. |
| 2008/0311558 A1 | 12/2008 | Ecker et al. |
| 2009/0004643 A1 | 1/2009 | Ecker et al. |
| 2009/0023150 A1 | 1/2009 | Koster et al. |
| 2009/0042203 A1 | 2/2009 | Koster |
| 2009/0092977 A1 | 4/2009 | Koster |
| 2009/0125245 A1 | 5/2009 | Hofstadler et al. |
| 2009/0148829 A1 | 6/2009 | Ecker et al. |
| 2009/0148836 A1 | 6/2009 | Ecker et al. |
| 2009/0148837 A1 | 6/2009 | Ecker et al. |
| 2009/0182511 A1 | 7/2009 | Ecker et al. |
| 2009/0239224 A1 | 9/2009 | Ecker et al. |
| 2010/0070194 A1 | 3/2010 | Ecker et al. |
| 2010/0145626 A1 | 6/2010 | Ecker et al. |
| 2010/0184035 A1 | 7/2010 | Hall et al. |

FOREIGN PATENT DOCUMENTS

| | | |
|---|---|---|
| DE | 19732086 A1 | 1/1999 |
| DE | 19802905 | 7/1999 |
| DE | 19824280 | 12/1999 |
| DE | 19852167 | 5/2000 |
| DE | 19943374 A1 | 3/2001 |
| DE | 10132147 A1 | 2/2003 |
| EP | 281390 A2 | 9/1988 |
| EP | 633321 A1 | 1/1995 |
| EP | 620862 B1 | 4/1998 |
| EP | 1035219 A1 | 9/2000 |
| EP | 1138782 | 10/2001 |
| EP | 1234888 | 8/2002 |
| EP | 1308506 A1 | 5/2003 |
| EP | 1310571 A2 | 5/2003 |
| EP | 1333101 | 8/2003 |
| EP | 1365031 A1 | 11/2003 |
| EP | 1234888 A3 | 1/2004 |
| EP | 1748072 A1 | 1/2007 |
| FR | 2811321 A1 | 1/2002 |
| GB | 2325002 | 11/1998 |
| GB | 2339905 | 2/2002 |
| JP | 5276999 A2 | 10/1993 |
| JP | 11137259 A | 5/1999 |
| JP | 24024206 A2 | 1/2004 |
| JP | 2004000200 A2 | 1/2004 |
| JP | 24201679 A2 | 7/2004 |
| JP | 2004201641 A | 7/2004 |

| | | |
|---|---|---|
| WO | WO8803957 A1 | 6/1988 |
| WO | WO9015157 A1 | 12/1990 |
| WO | WO9205182 A1 | 4/1992 |
| WO | WO9209703 A1 | 6/1992 |
| WO | WO9219774 A1 | 11/1992 |
| WO | WO93/03186 | 2/1993 |
| WO | WO9305182 A1 | 3/1993 |
| WO | WO9308297 A1 | 4/1993 |
| WO | WO94/16101 | 7/1994 |
| WO | WO94/21822 | 9/1994 |
| WO | WO9419490 A1 | 9/1994 |
| WO | WO9504161 A1 | 2/1995 |
| WO | WO9511996 A1 | 5/1995 |
| WO | WO9513395 A1 | 5/1995 |
| WO | WO9513396 A2 | 5/1995 |
| WO | WO9531997 A1 | 11/1995 |
| WO | WO9606187 A1 | 2/1996 |
| WO | WO9616186 A1 | 5/1996 |
| WO | WO96/29431 | 9/1996 |
| WO | WO96/32504 | 10/1996 |
| WO | WO96/37630 | 11/1996 |
| WO | WO9635450 A1 | 11/1996 |
| WO | WO97/33000 | 9/1997 |
| WO | WO9734909 A1 | 9/1997 |
| WO | WO97/37041 | 10/1997 |
| WO | WO9747766 A1 | 12/1997 |
| WO | WO98/03684 | 1/1998 |
| WO | WO98/12355 | 3/1998 |
| WO | WO98/14616 | 4/1998 |
| WO | WO98/15652 | 4/1998 |
| WO | WO98/20020 | 5/1998 |
| WO | WO98/20157 | 5/1998 |
| WO | WO98/20166 | 5/1998 |
| WO | WO98/26095 | 6/1998 |
| WO | WO98/31830 | 7/1998 |
| WO | WO9835057 A1 | 8/1998 |
| WO | WO98/40520 | 9/1998 |
| WO | WO98/54751 | 12/1998 |
| WO | WO9854571 A1 | 12/1998 |
| WO | WO99/05319 | 2/1999 |
| WO | WO99/14375 | 3/1999 |
| WO | WO9912040 A2 | 3/1999 |
| WO | WO9913104 A1 | 3/1999 |
| WO | WO99/29898 | 6/1999 |
| WO | WO99/31278 | 6/1999 |
| WO | WO99/57318 | 11/1999 |
| WO | WO9958713 A2 | 11/1999 |
| WO | WO9960183 A1 | 11/1999 |
| WO | WO0032750 A1 | 6/2000 |
| WO | WO0038636 A1 | 7/2000 |
| WO | WO0063362 A1 | 10/2000 |
| WO | WO0066762 A2 | 11/2000 |
| WO | WO0066789 A2 | 11/2000 |
| WO | WO0077260 A1 | 12/2000 |
| WO | WO0100828 A2 | 1/2001 |
| WO | WO01/07648 | 2/2001 |
| WO | WO0112853 A1 | 2/2001 |
| WO | WO0120018 A2 | 3/2001 |
| WO | WO01/23604 | 4/2001 |
| WO | WO0123608 A2 | 4/2001 |
| WO | WO01/32930 | 5/2001 |
| WO | WO0140497 A2 | 6/2001 |
| WO | WO0146404 A1 | 6/2001 |
| WO | WO01/51661 | 7/2001 |
| WO | WO0151662 A1 | 7/2001 |
| WO | WO01/57263 | 8/2001 |
| WO | WO0157518 A2 | 8/2001 |
| WO | WO0173119 A2 | 10/2001 |
| WO | WO0173199 A1 | 10/2001 |
| WO | WO0177392 A2 | 10/2001 |
| WO | WO0196388 A2 | 12/2001 |
| WO | WO0202811 A2 | 1/2002 |
| WO | WO02/10186 | 2/2002 |
| WO | WO0210444 A1 | 2/2002 |
| WO | WO02/18641 | 3/2002 |
| WO | WO02/21108 | 3/2002 |
| WO | WO0222873 A1 | 3/2002 |
| WO | WO0224876 A2 | 3/2002 |
| WO | WO92/08117 | 5/2002 |
| WO | WO02/50307 | 6/2002 |
| WO | WO02/057491 | 7/2002 |
| WO | WO02070664 A2 | 9/2002 |
| WO | WO02070728 A2 | 9/2002 |
| WO | WO02070737 A2 | 9/2002 |
| WO | WO02/077278 | 10/2002 |
| WO | WO02/099034 | 12/2002 |
| WO | WO02099095 A2 | 12/2002 |
| WO | WO02099129 A2 | 12/2002 |
| WO | WO02099130 A2 | 12/2002 |
| WO | WO03/002750 | 1/2003 |
| WO | WO03/008636 | 1/2003 |
| WO | WO03001976 A2 | 1/2003 |
| WO | WO03/016546 | 2/2003 |
| WO | WO03012058 A2 | 2/2003 |
| WO | WO03012074 A2 | 2/2003 |
| WO | WO03014382 A2 | 2/2003 |
| WO | WO03018636 A2 | 3/2003 |
| WO | WO03020890 A2 | 3/2003 |
| WO | WO03033732 A2 | 4/2003 |
| WO | WO03/060163 | 7/2003 |
| WO | WO03054162 A2 | 7/2003 |
| WO | WO03054755 A2 | 7/2003 |
| WO | WO03075955 A1 | 9/2003 |
| WO | WO03/088979 | 10/2003 |
| WO | WO03/097869 | 11/2003 |
| WO | WO03093506 A2 | 11/2003 |
| WO | WO03100035 A2 | 12/2003 |
| WO | WO03100068 A1 | 12/2003 |
| WO | WO03102191 A1 | 12/2003 |
| WO | WO03104410 A2 | 12/2003 |
| WO | WO03106635 A2 | 12/2003 |
| WO | WO2004003511 A2 | 1/2004 |
| WO | WO2004009849 A1 | 1/2004 |
| WO | WO2004011651 A1 | 2/2004 |
| WO | WO2004013357 A2 | 2/2004 |
| WO | WO2004040013 A1 | 5/2004 |
| WO | WO2004044123 A2 | 5/2004 |
| WO | WO2004044247 A2 | 5/2004 |
| WO | WO2004052175 A2 | 6/2004 |
| WO | WO2004053076 A2 | 6/2004 |
| WO | WO2004053141 A2 | 6/2004 |
| WO | WO2004053164 A1 | 6/2004 |
| WO | WO2004060278 A2 | 7/2004 |
| WO | WO2004070001 A2 | 8/2004 |
| WO | WO2004072230 A2 | 8/2004 |
| WO | WO2004072231 A2 | 8/2004 |
| WO | WO2004101809 A2 | 11/2004 |
| WO | WO2005003384 A1 | 1/2005 |
| WO | WO2005009202 A2 | 2/2005 |
| WO | WO2005012572 A1 | 2/2005 |
| WO | WO2005024046 A2 | 3/2005 |
| WO | WO2005036369 A2 | 4/2005 |
| WO | WO2005054454 A1 | 6/2005 |
| WO | WO2005075686 A1 | 8/2005 |
| WO | WO2005086634 A2 | 9/2005 |
| WO | WO2005091971 A2 | 10/2005 |
| WO | WO2005098047 A2 | 10/2005 |
| WO | WO2005116263 A2 | 12/2005 |
| WO | WO2006089762 A1 | 8/2006 |
| WO | WO2006094238 A2 | 9/2006 |
| WO | WO2006135400 A2 | 12/2006 |
| WO | WO2007014045 A2 | 2/2007 |
| WO | WO2007086904 A2 | 8/2007 |
| WO | WO2008104002 A2 | 8/2008 |
| WO | WO2008118809 A1 | 10/2008 |

OTHER PUBLICATIONS

U.S. Appl. No. 10/323,186, filed Dec. 18, 2002, Ecker et al.
U.S. Appl. No. 10/323,187, filed Dec. 18, 2002, Ecker et al.
U.S. Appl. No. 10/323,210, filed Dec. 18, 2002, Ecker et al.
U.S. Appl. No. 10/323,211, filed Dec. 18, 2002, Ecker et al.
U.S. Appl. No. 10/323,233, filed Dec. 18, 2002, Ecker et al.
U.S. Appl. No. 10/323,438, filed Dec. 18, 2002, Ecker et al.
U.S. Appl. No. 10/324,721, filed Dec. 18, 2002, Ecker et al.
U.S. Appl. No. 10/325,526, filed Dec. 18, 2002, Ecker et al.
U.S. Appl. No. 10/325,527, filed Dec. 18, 2002, Ecker et al.
U.S. Appl. No. 10/326,046, filed Dec. 18, 2002, Ecker et al.

U.S. Appl. No. 10/326,047, filed Dec. 18, 2002, Ecker et al.
U.S. Appl. No. 10/326,050, filed Dec. 18, 2002, Ecker et al.
U.S. Appl. No. 10/326,051, filed Dec. 18, 2002, Ecker et al.
U.S. Appl. No. 10/326,641, filed Dec. 18, 2002, Ecker et al.
U.S. Appl. No. 10/326,642, filed Dec. 18, 2002, Ecker et al.
U.S. Appl. No. 10/326,643, filed Dec. 18, 2002, Ecker et al.
U.S. Appl. No. 10/326,644, filed Dec. 18, 2002, Ecker et al.
U.S. Appl. No. 10/340,321, filed Jan. 10, 2003, Ecker et al.
U.S. Appl. No. 10/340,461, filed Jan. 10, 2003, Ecker et al.
U.S. Appl. No. 10/340,482, filed Jan. 10, 2003, Ecker et al.
U.S. Appl. No. 10/340,483, filed Jan. 10, 2003, Ecker et al.
U.S. Appl. No. 10/405,756, filed Mar. 31, 2003, Ecker.
U.S. Appl. No. 10/418,514, filed Apr. 18, 2003, Ecker et al.
U.S. Appl. No. 10/430,253, filed May 6, 2003, Ecker et al.
U.S. Appl. No. 10/435,307, filed May 9, 2003, Ecker et al.
U.S. Appl. No. 10/439,690, filed May 16, 2003, Ecker et al.
U.S. Appl. No. 10/439,706, filed Jun. 26, 2002, Ecker et al.
U.S. Appl. No. 10/660,996, filed Sep. 12, 2003, Ecker et al.
U.S. Appl. No. 10/660,997, filed Sep. 12, 2003, Ecker et al.
U.S. Appl. No. 10/660,998, filed Sep. 12, 2003, Ecker et al.
U.S. Appl. No. 10/728,486, filed Dec. 5, 2003, Ecker et al.
U.S. Appl. No. 10/796,867, filed Mar. 9, 2004, Ecker.
Aaserud et al., "Accurate base composition of double-strand DNA by mass spectrometry," J. Am. Soc. Mass Spec., 1996, 7, 1266-1269.
Bahrmand et al., "Polymerase chain reaction of bacterial genomes with single universal primer: application to distinguishing Mycobacteria species," Mol. Cell. Probes, 1996, 10, 117-122.
Bahrmand at al., "Use of restriction enzyme analysis of amplified DNA coding for the hsp65 gene and polymerase chain reaction with universal primer for rapid differtiation of *Mycobacterium* species in the clinical laboratory," Scand. J. Infect. Dis., 1998, 30, 477-480.
Baker et al., "Review and re-analysis of domain-specific 16S primers," J. Microbiol. Methods, 2003, 55, 541-555.
Bastia et al., "Organelle DNA analysis of *Solanum* and *Brassica* somatic hybrids by PCR with universal primers," Theor. Appl. Genet, 2001, 102, 1265-1272.
Batey et al., "preparation of isotopically labeled ribonucleotides for multidimensional NMR spectroscopy of RNA," Nuc. Acids Res., 1992, 20, 4515-4523.
Benson et al., "Advantages of *Thermococcus kodakaraenis* (KOD) DNA polymerase for PCR-mass spectrometry based analyses," J. Am. Soc. Mass Spectrom., 2003, 14, 601-604.
Black et al., "Detection of trace levels of tricothecene mycotoxins in human urineby gas chromatography-mass spectrometry," J. Chromatog., 1986, 367, 103-115.
Bowen et al., "The native virulence plasmid combination affects the segregational stability of a theta-replicating shuttle vector in *Bacillus anthracis* var, New Hampshire," J. Appl. Microbiol., 1999, 87, 270-278.
Campbell et al., "Detection of California serogroup Bunyavirus in tissue culture and mosquito pools by PCR," J. Virol. Methods, 1996, 57, 175-179.
Cespedes et al., "Polymerase chain reaction-restriction fragment length polymorphism analysis of a short fragment of the cytochrome b gene for identification of flatfish species," J. Food Protection, 1998, 61, 1684-1685.
Chen et al., "A universal PCR primer to detect members of the Potyviridae and its use to examine the taxonomic status of several members of the family," Arch. Virol., 2001, 146, 757-766.
Chen et al., "Universal primers for amplification of mitochondrial small subunit ribosomal RNA-encoding gene in scleractinian corals," Mar. Biotechnol., 2000, 2, 146-153.
Cho et al., "Application of the ribonuclease P (RNase P) RNA gene sequence for phylogenetic analysis of the genus *Saccharomonospora*," Int. J. Sys. Bacteriol., 1998, 1223-1230.
Conrads et al., "16S-23S rDNA internal transcribed spacer sequences for analysis of the phylogenetic relationships among species of the genus *Fusobacterium*," Intl. J. System. Evol. Micrbiol., 2002, 52, 493-499.
Cornel et al., "Polymerase chain reaction species diagnostic assay for *Anopheles quadrimaculatus* cryptic species (Diptera:Culicidae) based on ribosomal DNA ITS2 sequences," J. Med. Entomol., 1996, vol. 33, No. 1, pp. 110-116.
Crain et al., "Applications of mass spectrometry to the characterization of oligonucleotides and nucleic acids," Anal. Biotechnol., 1998, pp. 25-34.
Deforce et al., "Analysis of Oligonucleotides by ESI-MS," (2000) Book, Ch. 11, 541-566.
Dasen et al., "Classification and identification of Propioibacteria based on ribosomal RNA genes and PCR," System. Appl. Microbiol., 1998, 21, 251-259.
Deforce et al., "Characterization of DNA oligonucleotides by coupling of capillary zone electrophoresis to electrospray ionization Q-TOF mass spectrometry," Anal. Chem., 1998, 70, 3060-3068.
Demesure et al., "A set of universal primers for amplification of polymorphic non-coding regions of mitochondrial and chloroplast DNA in plants," Mol. Ecol., 1995, 4, 129-131.
Dinauer et al., "Sequence-based typing of HLA class II DQBI," Tissue Antigens, 2000, 55, 364-368.
Ding et al., "A high-throughput gene expression analysis technique using compettiive PCR and matrix-assisted laser desorption ionization time-of-flight MS," Proc. Natl. Acad. Sci., 2003, 100, 3059-3064.
Dubernet et al., "A PCR-based method for identification of *Lactobacilli* at te genus level," FEMS Microbiol. Lett., 2002, 214, 271-275.
Figueiredo et al., "Identification of *Brazilian Flavivirus* by a simplified reverse transcription-polymerase chain reaction method using Flavivirus universal primers," Am. J. Trop. Med. Hyg., 1998, 59, 357-362.
Flora et al., "Dual-micro-ESI source for precise mass determination on a quadrupole time-of-flight mass spectrometer for genomic and proteomic applications," Anal. Bioanal. Chem., 2002, 373, 538-546.
Fox et al., "Identification of *Brucella* by ribosomal-spacer-region PCR and differentiation of Brucell canis from other *Brucella* spp. pathogenic for humans by carbohydrate profiles," J. Clin. Microbiol., 1998, 36, 3217-3222.
Fox et al., "Report of the 'Bioterrorism Workshop'", J. Microbol. Methods, 2002, 51, 247-254.
Fraser et al., "The mimimal gene complement of *Mycoplasma genitalium*," Science, 1995, 270, 397-403.
Griffey et al., "Detection of base pair mismatches in duplex DNA and RNA oligonucleotides using electrospray mass spectrometry," SPIE, 1997, 2985, 82-86.
Griffin et al., "Direct genetic analysis by matrix-assisted laseer desorption/ionization mass spectrometry," Proc. Natl. Acad. Sci. USA, 1999, 96, 6301-6306.
Hannis et al., Accurate characterization fo the tyrosine hydroxylase forensic allele 9.3 through development of electrospray ionization Fourier transform ion cyclotron resonance mass spectrometry: Rapid. Comm. Mass Spectrom., 1999, 13, 954-962.
Hannis et al., "Genotyping short tandem repeats using flow injection and electrospray ionization Fourier transform ion cyclotron resonance mass spectrometry," Rapid. Comm. Mass Spectrom., 2001, 15, 348-350.
Hannis et al., "Detection of double-stranded PCR amplicons at the attomole level electrosprayed from low nanomolar solutions using FT-ICR mass spectrometry," Fresenius J. Anal Chem., 2001, 369, 246-251.
Hannis et al., "Genotyping complex short tandem repeats using electrospray ionization Fourier transform ion cyclotron resonance multi-stage mass spectrometry," SPIE, 2000, 3926, 36-47.
Hayashi et al., "Phylogenetic analysis of the human gut microbiota using 16S rDNA clone libraries and strictly anaerobic culture based methods," Microbiol. Immunol., 2002, 46, 535-548.
Henchal et al, "Sensitivity and specificity of a universal primer set for the rapid diagnosis of dengue virus infections by polymerase chain reaction and nucleic acid hybridization," Am. J. Trop. Med. Hyg., 1991, 45, 418-428.
Higgins et al., "Competitive oligonucleotide single-base extension combined with mass spectrometric detection for mutation screening," Biotechniques, 1997, 23, 710-714.
Hoffmann et al., "Universal primer set for the full-length amplification of all influenza A viruses," Arch. Virol., 2001, 146, 2275-2289.
Honda et al., "Universal method of hypersensitive nested PCR toward forensic DNA typing," Prog. Forensic Genet., 1998, 7, 28-30.

Hongoh et al., "Evaluation of primers and PCR conditions for the analysis of 16s rRNA genes from a natural environment," FEMS Microbiol. Lett., 2003, 221, 299-304.

Hurst et al., "Detection of bacterial DNA polymerase chain reaction products by matrix-assisted laser desorption/ionization mass spectrometry," Rapid Commun. Mass Spec., 1996, 10, 377-382.

Hung, "Detection of SARS coronavirus RNA in the cerebrospinal fluid of a patient with severe acute respiratory syndrome," Clin. Chem., 2003, 2108-2109.

Isola et al., "MALDI-TOF mass spectrometric method for detection of hybridized DNA oligomers," Anal. Chem., 2001, 73, 2126-2131.

Jankowski et al., "Mass spectrometry of DNA: Part 2* Quantitative estimation of base composition," Eur. J. Mass Spectrom. Biochem. Med. Environ. Res., 1980, 1, 45-52.

Kageyama et al., "Rapid detection of human fecal *Eubacterium* species and related genera by tested PCR method," Microbiol. Immunol., 2001, 45, 315-318.

Krahmer et al., "Electrospray quadrupole mass spectrometry analysis of model oligonucleotides and polymerase chain reaction products: determination of base substitutions, nucleotide additions/deletions, and chemical modifications," Anal. Chem., 1999, 71, 2893-2900.

Krahmer et al., "MS for identification of single nucleotide polymorphisms and MS/MS for discrimination of isomeric PCR products," Anal. Chem., 2000, 72, 4033-4040.

Lau et al., "A real-time PCR for SARS-coronavirus Incorporating target gene pre-amplification," Biochem. Biophys. Res. Comm., 2003, 312, 1290-1296.

Li et al., "Single nucleotide polymorphism determination using primer extension and time-of-flight mass spectrometry," Electrophoresis, 1999, 20, 1258-1265.

Little et al., "Rapid sequencing of oligonucleotides by high-resolution mass spectrometry," J. Am. Chem. Soc., 1994, 116, 4893-4897.

Liu et al., "Improving the microdialysis procedure for electrospray ionization mass spectrometry of biological samples," J. Mass Spectrom., 1997, 32, 425-431.

Loakes et al., "Nitroindoles as universal bases," Nucleosides and Nucleotides, 1995, 14(3-5), 1001-1003.

Maiwald et al., "Characterization of contaminating DNA in Taq polymerase which occurs during amplification with a primer set for Legionella 5S ribosomal RNA," Mol. Cell. Probes, 1994, 8, 11-14.

Mangrum et al., "Solution composition and thermal denaturation for the production of single-stranded PCR amplicons: piperidine-induced destabilization of the DNA duplex," J. Am. Soc. Mass Spectrom., 2002, 13, 232-240.

Matray et al., "Synthesis and properties of RNA analogs—oligoribonucleotide N3'->P5' phosphoramidates," Nucleic Acids Res., 1999, 3976-3985.

McCabe et al., "Bacterial species Identification after DNA amplification with a universal primer pair," Mol. Genet. Metab., 1999, 66, 205-211.

Meiyu et al., "Detection of flaviviruses by reverse transcriptase-polymerase chain reaction with the universal primer set," Microbiol. Immunol., 1997, 41, 209-213.

Messmer et al., "Discrimination of *Streptococcus pneumoniae* from other upper respiratory tract *Streptococci* by arbitrary primed PCR," Clin. Biochem., 1995, 28, 567-572.

Moricca et al., "Detection of *Fusarium oxysporum* f.sp. *Vasinfectum* in cotton tissue by polymerase chain reaction," Plant Pathol., 1998, 47, 486-494.

Muddiman et al., "Characterization of PCR products from Bacilli using electrospray ionization FTICR mass spectrometry," Anal Chem., 1996, 68, 3705-3712.

Muddiman et al., "Length and base composition of PCR-amplified nucleic acids using mass measurements from electrospray ionization mass spectrometry," Anal. Chem., 1997, 69, 1543-1549.

Muddiman et al., "Important aspects concerning the quantification of biomolecules by time-of-flight secondary-ion mass spectrometry," Appl. Spectrometry, 1996, 50, 161-166.

Muddiman et al., "Application of secondary ion and matrix-assisted laser desorption-ionization time-of-flight mass spectrometry for the quantitative analysis of biological molecules," Mass Spectrom. Rev., 1995, 14, 383-429.

Muddiman et al., "Precise mass measurement of a double-stranded 500 base-pair (309 kDa) polymerase chain reaction product by negative ion electrospray ionization fourier transform ion cyclotron resonance mass spectrometry," Rapid Commun. Mass Spec., 1999, 13, 1201-1204.

Muddiman et al., "Sequencing and characterization of larger oligonucleotides by electrospray ionization fourier transform ion cyclotron resonance mass spectrometry," Rev. Anal. Chem., 1998, 17, 1-68.

Muhammed et al., "Electrospray ionization quadrupole time-of-flight mass spectrometry and guadrupole mass spectrometry for genotyping single nucleotide substitutions in intact polymerase chain reaction products in K-ras and p53," Rapid Comm. Mass Spectrom., 2002, 16, 2278-2285.

Mushegian et al., "A minimal gene set for cellular life derived by comparison of complete bacterial genomes," Proc. Natl. Acad. Sci. USA, 1996, 93, 10268-10273.

Nagpal et al., "Utility of 16S-23S rRNA spacer region methodology: how similar are interspace regions within a genome and between strains for closely related organisms?, " J. Microbiol. Methods, 1998, 33, 211-219.

Ng et al., "Serial analysis of the plasma concentration of SARS coronavirus RNA in pediatric patients with severe acute respiratory syndrome," Clin. Chem., 2003, 49, 2085-2088.

Ng et al., "Quantitative analysis an prognostic implication of SARS coronavirus RNA in the plasma and serum of patients with severe acute respiratory syndrome," Clin. Chem., 2003, 49, 1976-1980.

Null et al., "Preparation of single-stranded PCR products for electrospray ionization mass spectrometry using the DNA repair enzyme lambda exonuclease," Analyst, 2000, 125, 619-626.

Null et al., "Evaluation of sample preparation techniques for mass measurements of PCR products using ESI-FT-ICR mass spectrometry," Am Soc. Mass Spectrom., 2002, 13, 338-344.

Null et al., "Determination of a correction to improve mass measurement accuracy of isotopically unresolved polymerase chain reaction amplicons by electrospray ionization Fourier transform ion cyclotron resonance mass spectrometry," Rapid Comm. Mass Spectrom., 2003, 17, 1714-1722.

Null et al., "Perspectives on the use of electrospray ionization Fourier transform ion cyclotron resonance mass spectrometry for short tandem repeat genotyping in the post genome era," J. Mass Spectrom., 2001, 36, 589-606.

Null et al., "Genotyping of simple and compound short tandem repeat loci using electrospray ionization Fourier transform ion cyclotron resonance mass spectrometry," Anal. Chem., 2001, 73, 4514-4521.

Null et al., "Implications of hydrophobicity and free energy of solvation for characterization of nucleic acids by electrospray ionization mass spectrometry," Anal. Chem., 2003, 75, 1331-1339.

Oberacher et al., "Analysis of polymerase chain reaction products by on-line liquid chromatography—mass spectrometry for genotyping of polymeric short tandem repeat loci," 2001, 73, 5109-5115.

Peng et al., "Rapid detection of *Shigella* species in environmental sewage by en immunocapture PCR with universal primers," App. Environ. Microbiol., 2002, 68, 2580-2583.

Pomerantz et al., "Determination of oligonucleotide composition from mass spectrometrically measured molecular weight," J. Am. Soc. Mass Spectrom., 1993, 4, 204-209.

Reid et al., "Primary diagnosis of foot-and-mouth disease by reverse transcription polymerase chain reaction," J. Virol. Met., 2000, 167-176.

Reilly et al., "Design and use of 16s ribosomal DNA-directed primers in competitive PCRs to enumerate proteolytic bacteria in the rumen," Microb. Ecol., 2002, 43, 259-270.

Ross et al., "Discrimination of single-nucleotide polymorphisms in human DNA using peptide nucleic acid probes detected by MALDI-TOF mass spectrometry," Anal. Chem., 1997, 69, 4197-4202.

Ross at al., "Analysis of DNA fragments from conventional and microfabricated PCR devices using delayed extraction MALDI-TOF mass spectrometry," Anal. Chem., 1998, 70, 2067-2073.

Sala at al.. "Ambiguous base pairing of the purine analogue 1-(2-deoxy-β-D -ribofuranosyl)-imidazole-4-carboxamide during PCR," Nucl. Acids Res., 1996, 24(17), 3302-3306.

Scaramozzino et al., "Comparison of *Flavivirus* universal primer pairs and development of a rapid, highly sensitive heminested reverse transcription-PCR assay for detection of flaviviruses targeted to a conserved region of the NS5 gene sequences," J. Clin. Microbiol., 2001, 39, 1922-1927.

Schram, "Mass Spectrometry of Nucleic Acid Components" in Biomedical Applications of Mass Spectrometyr, 34:203-287.

Schultz et al., "Polymerase chain reaction products analyzed by charge detection mass spectrometry," Rapid Comm. Mass Spectrom., 1999, 13, 15-20.

Shaver et al., "Restriction fragment length polymorphism of rRNA operons for discrimination and intergenic spacer sequences for cataloging of *Bacilus subtilis* sub-groups," J. Microbiol. Methods, 2002, 50, 215-223.

Shaver et al., "Variation in 16s-23s rRNA Intergenic spacer regions among *Bacilus subtilis* 168 isolates," Mol. Microbiol., 2001, 42, 101-109.

Rong et al., "Design and application of 60mer oligonucleotide microarray in SARS coronavirus detection," Chinese Sci. Bull., 2003, 48, 1165-1169.

Song et al, "Identification of cry11-type genes from *Bacilus thuringiensis* strains and characterization of a novel cry11-type gene," App. Environ. Microbiol., 2003, 69, 5207-5211.

Srinivasan et al., "Matrix-assisted laser desorption/ionization time-of-flight mass spectrometry as a rapid screening method to detect mutations causing Tay-Sachs disease," Rapid Comm. Mass Spectrom., 1997, 11, 1144-1150.

Steffens et al., "Sequence analysis of mitochondrial DNA hypervariable regions using infrared fluorescence detection," Bio/Techniques, 1998, 24, 1044-1046.

Boivin-Jahns et al., "Bacterial diversity in a deep-subsurface clay environment," *Applied and Environmental Microbiology* (1996) 62(9):3405-3412.

Tsuneyoshi et al., "Mass spectrometric gene diagnosis of one-base substitution from polymerase chain reaction amplified human DNA," 1997, 11, 719-722.

Van Aerschot et al., "In search of acyclic analogues as universal nucleosides in degenerate probes," Nucleosides and Nucleotides, 1995, 14(3-5), 1053-1056.

Van Camp et al., "Amplification and sequencing of variable regions in bacterial 23s ribosomal RNA genes with conserved primer sequences," Curr. Microbiol., 1993, 27, 147-151.

Walters et al., "Genotyping single nucleotide polymorphisms using intact polymerase chain reaction products by electrospray quadrupole mass spectrometry," Rapid Comm. Mass Spectrom., 2001, 25, 1752-1759.

Welham et al., Rapid Communications in Mass Spectroscopy, 1988, 12, 176-180.

Wolter et al., "Negative ion FAB mass spectrometric analysis of non-charged key intermediates in oligonucleotide synthesis: rapid identification of partially protected dinucleoside monophosphates," Biomed. Environ. Mass Spectrom., 1987, 14, 111-116.

Woo et al., "Identification of *Leptospira inadai* by continuous monitoring of fluorescence during rapid cycle PCR," System. Appl. Microbiol., 1998, 21, 89-96.

Wu et al., "Establishment of a fluorescent polymerase chain reaction method for the detection of SARS-associated coronavirus and its clinical application," Chin. Med. J., 2003, 116, 988-990.

Wunschel et al., "Mass spectrometric characterization of DNA for molecular biological applications: advances using MALDI and ESI," Adv. Mass Spectrom., vol. 14, Karjalainen, et al., (eds.) 1998, Elsevier, Amsterdam.

Wunschel et al., "Analysis of double-stranded polymerase chain reaction products from the *Bacilus cereus* group by electrospray ionization Fourier transform ion cyclotron resonance mass spectrometry," Rapid Comm. Mass Spectrom., 1996, 10, 29-35.

Wunschel et al., "Heterogeneity in *Bacillus cereus* PCR products detected by ESI-FTICR mass spectrometry," Anal. Chem., 1998, 70, 1203-1207.

Yasui et al., "A specific oligonucleotide primer for the rapid detection of *Lactobacillus lindneri* by polymerase chain reaction," Can. J. Microbiol., 1997, 43, 157-163.

Hurst et al., MALDI-TOF Analysis of Polymerase Chain Reaction Products from Methanotrophic Bacteria, Anal. Chem. 1998, 70, 2693-2698.

Lacroix et al., "PCR-based technique for the detection of bacteria in semen and urine." Journal of Microbiological Methods, 26 (1996) 61-71.

Van Baar, "Characterization of bacterial by matrix-assisted laser desorption/ionization and electrospray mass spectrometry," FEMS Microbiology Reviews, 24 (2000) 193-219.

Ruan, et al., "Comparative full-length genome sequence analysis of 14 SARS coronavirus isolates and common mutations associated with the putative origins of infection,"Lancet (2003) 361:1832.

Mack and Sninsky, "A sensitive method for the identification of uncharacterized viruses related to known virus groups: Hepadnavirus model system," Proc. Natl. Acad. Sci. USA (1988) 85:6977-6981.

Oberste, et al., "Molecular phylogeny and proposed classification of the Simian picornaviruses," J. Virol. (2002) 76:1244-1251.

Stephensen, et al., "Phylogenetic analysis of a highly conserved region of the poymerase gene from 11 coronaviruses and development of a consensus poymerase chain reaction assay," Virus Res. (1999) 60:181-189.

Schmidt, et al., "Analysis of a marine picoplankton community by 16s rRNA gene cloning and sequencing," J. Bacteriol. (1991) 173:4371-4378.

Oberste, et al, "Improved molecular identification of enteroviruses by RT-PCR and amplicon sequencling," J. Clin. Virol. (2003) 26:375-377.

Oberste, et al., "Molecular epidemiology and type-specific detection of echovirus 11 isolates from the Americas, Europe, Africa, Australia, southern Asia and the Middle East," Virus Res. (2003) 91:241-248.

Kroes, et al., "Bacterial divesity within the human subgingival crevice," Proc. Natl. Acad. Sci. USA (1999) 98:14547-14552.

Seifarth, et al., "Rapid identification of all known retroviral reverse transcriptase sequences with a novel versatile detection assay," AIDS Res. Human Retrovir. (2000) 16;721-729.

Donehower, et al., "The use of primers from highly conserved pol regions to identify uncharacterized retroviruses by the polymerase chain reaction," J. Vir. Methods (1990) 28:33-46.

Echavarria, et al., "PCR method for detection of adenovirus in urine of healthy and human immunodeficiency virus-infected individuals," J. Clin. Microbiol. (1998) 36:3323-3326.

Aaserud D.J., et al., "DNA Sequencing with Blackbody Infrared Radioactive Dissociation of Electrosprayed Ions," International Journal of Mass Spectrometry and Icon Processes, 1997, vol. 167/168, pp. 705-712.

Adam E., et al., "Characterization of Intertype Specific Epitopes on Adenovirus Hexons," Archives of Virology, 1998, vol. 143 (9), pp. 1669-1682.

Adam E., et al., "Intertype Specific Epitope Structure of Adenovirus Hexon," Acta Microbiologica et Immunologica Hungarica, 1998, vol. 45 (3-4), pp. 311-316.

Adam E., et al., "Molecular Structure of the Two-Dimensional Hexon Crystalline Array and of Adenovirus Capsid," Acta Microbiologica et Immunologica Hungarica, 1998, vol. 45 (3- 4), pp. 305-310.

Adrian T., et al., "DNA Restriction Analysis of Adenovirus Prototypes 1 to 41," Archives of Virology, 1986, vol. 91 (3-4), pp. 277-290.

Adzhar A., et al., "Universal Oligonucleotides for the Detection of Infectious Bronchitis Virus by Thepolymerase Chain Reaction," Avian Pathology, 1996, vol. 25 (4), pp. 817- 836.

AgostinI H.T., et al., "Complete Genome of a JC Virus Genotype Type 6 from the Brain of an African American with Progressive Multifocal Leukoencephalopathy," Journal of Human Virology, 1998, vol. 1 (4), pp. 267-272.

Aires De Sousa M., et al., "Bridges from Hospitals to the Laboratory: Genetic Portraits of Methicillin-Resistant *Staphylococcus Aureus* Clones," FEMS Immunology and Medical Microbiology, 2004, vol. 40 (2), pp. 101-111.

Akalu A., et al., "Rapid Identification of Subgenera of Human Adenovirus by Serological and PCR Assays," Journal of Virological Methods, 1998, vol. 71 (2), pp. 187-196.

Alba M.M., et al., "VIDA: A Virus Database System for the Organization of Animal Virus Genome Open Reading Frames," Nucleic Acids Research, 2001, vol. 29 (1), pp. 133-136.

Allaouchiche B., et al., "Clinical Impact of Rapid Oxacillin Susceptibility Testing Using a PCR Assay in *Staphylococcus Aureus* Bactaeremia," The Journal of Infection, 1999, vol. 39 (3), pp. 198-204.

Allawi H.T., et al., "Thermodynamics and NMR of Internal G.T. Mismatches in DNA," Biochemistry, 1997, vol. 36 (34), pp. 10581-10594.

Altschuel S.F., et al., "Basic Local Alignment Search Tool," Journal of Molecular Biology, 1990, vol. 215 (3), pp. 403-410.

Altschuel S.F., et al., "Gapped BLAST and PSI-BLAST: A New Generation of Protein Database Search Programs," Nucleic Acids Research, 1997, vol. 25 (17), pp. 3389-3402.

Alves-Silva J., et al., "The Ancestry of Brazilian mtDNA Linages," The American Journal of Human Genetics, 2000, vol. 67 (2), pp. 444-461.

Amano Y., et al., "Detection of Influenza Virus: Traditional Approaches and Development of Biosensors," Analytical and Bioanalytical Chemistry, 2005, vol. 381 (1), pp. 156-164.

Amexis G., et al., "Quantitative Mutant Analysis of Viral Quasispecies by Chip-Based Matrix Assisted LaserDesorption Ionization Time-of-Flight Mass Spectrometry," Proceedings of the National Academy of Sciences, 2001, vol. 98 (21), pp. 12097-12102.

Anderson M.L.M., "Quantitative Filter Hybridization" in: Nucleic Acid Hybridization, Names B.D., ed., IRL Press, 1985, pp. 73-111.

Anderson S., et al., "Sequence and Organization of the Human Mitochondrial Genome," Nature, 1981, vol. 290 (5806), pp. 457-465.

Andreasson H., et al., "Mitochondrial Sequence Analysis for Forensic Identification Using Pyrosequencing Technology," BioTechniques, 2002, vol. 32 (1), pp. 124-133.

Anthony R.M., et al., "Use of the Polymerase Chain Reaction for Rapid Detection of High-Level Mupirocin Resistance in *Staphylococci*," European Journal of Clinical Microbiology & Infectious Diseases, 1999, vol. 18 (1), pp. 30-34.

Arbique J., et al., "Comparison of the Velogene Rapid MRSA Identification Assay, Denka MRSAScreen Assay, and BBL Crystal MRSA ID System for Rapid Identification of Methicillin-Resistant *Staphylococcus Aureus*," Diagnositic Microbiology and Infectious Diseases, 2001, vol. 40 (1-2), pp. 5-10.

Archer G.L., et al., "Detection of Methicillin Resistance in *Staphylococci* by Using a DNA Probe," Antimicrobial Agents and Chemotherapy, 1990, vol. 34 (9), pp. 1720-1724.

Armstrong P., et al., "Sensitive and Specific Colorimetric Dot Assay to Detect Eastern Equine Encephalomyelitis Viral RNA in Mosquitoes After PCR Amplification," Journal of Medicinal Entomology, 1995, vol. 32 (1), pp. 42-52.

Arnal C., et al., "Quantification of Hepatitis A Virus in Shellfish by Competitive Reverse Transcription PCR with Coextraction of Standard RNA," Applied and Environmental Microbiology, 1999, vol. 65 (1), pp. 322-326.

Aronsson F., et al., "Persistence of the Influenza A/WSN/33 Virus RNA at Midbrain Levels of Immunodefective Mice," Journal of Neurovirology, 2001, vol. 7 (2), pp. 117-124.

Ausubel F.M., et al., Eds., Current Protocols in Molecular Biology, vol. 1, John Wiley & Sons Inc., 2004, Table of Contents.

Ausubel F.M., et al., eds., Short Protocols in Molecular Biology: A Compendium of Methods from Current Protocols in Molecular Biology, 2nd Edition, John Wiley & Sons, 1992, Units 2.9, 3.4-3.17, 4.6-4.10, and 10.8.

Ausubel F.M., et al., "Unit 2.11 "Synthesis and Purification of Oligonucleotides," in: Current Protocols in Molecular Biology," 1998, John Wiley & Sons, Inc., pp. 2.11-2.11.21.

Avellon A., et al., "Rapid and Sensitive Diagnosis of Human Adenovirus Infections by a Generic Polymerase Chain Reaction," Journal of Virological Methods, 2001, vol. 92 (2), pp. 113-120.

Azevedo a.M., et al., "Detection of Influenza, Parainfluenza, Adenovirus and Respiratory Syncytial Virus during Asthma Attacks in Children Older than 2 Years Old," Allergologia Immunopathologia, 2003, vol. 31 (6), pp. 311-317.

Baba T., et al., "Genome and Virulence Determinants of High Virulence Community-Acquired MRSA," Lancet, 2002, vol. 359 (9320), pp. 1819-1827.

Bai J., et al., "Matrix-Assisted Laser Desorption/Ionization Mass Spectrometry of Restriction Enzyme-Digested Plasmid DNA Using an Active Nafion Substrate," Rapid Communications in Mass Spectrometry, 1994, vol. 8 (9), pp. 687-691.

Banik U., et al., "Multiplex PCR Assay for Rapid Identification of Oculopathogenic Adenoviruses by Amplification of the Fiber and Hexon Genes," Journal of Clincal Microbiology, 2005, vol. 43 (3), pp. 1064-1068.

Barbour A.G., et al., "Identification of an Uncultivatable Borrelia Species in the Hard Tick *Amblyomma Americanum*: Possible Agent of a Lyme Disease-Like Illness," The Journal of Infectious Diseases, 1996, vol. 173 (2), pp. 403-409.

Barns S.M., et al., "Detection of Diverse New Francisella-like Bacteria in Environmental Samples," Applied and Environmental Microbiology, 2005, vol. 71 (9), pp. 5494-5500.

Baron E.J., "Genetic Aspects of Methicillin Resistance in *Staphylococcus aureus* and MethodsUsed for its Detection in Clinical Laboratories in the United States," Journal of Chemotherapy, 1995, vol. 7 (Suppl. 3), pp. 87-92.

Barr I.G., et al., "An Influenza A(H3) Reassortant was Epidemic in Australia and New Zealand in 2003," Journal of Medical Virology, 2005, vol. 76 (3), pp. 391-397.

Barski P., et al., "Rapid Assay for Detection of Methicillin-Resistant *Staphylococcus Aureus* Using Multiplex PCR," Molecular and Cellular Probes, 1996, vol. 10 (6), pp. 471- 475.

Baumer A., et al., "Age-Related Human mtDNA Deletions: A Heterogeneous Set of Deletions Arising at aSingle Pair of Directly Repeated Sequences," American Journal of Human Jenetics, 1994, vol. 54 (4), pp. 618-630.

Beall B., et al., "Sequencing emm-Specific PCR Products for Routine andAccurate Typing of Group A *Streptococci*," Journal of Clincal Microbiology, 1996, vol. 34 (4), pp. 953-958.

Beall B., et al., "Survey of emm Gene Sequences and T-Antigen Types from Systemic *Streptococcus pyogenes* Infection Isolates Collected in San Francisco, California; Atlanta, Georgia; and Connecticut in 1994 and 1995," Journal of Clincal Microbiology, 1997, vol. 35 (5), pp. 1231-1235.

Benko, M. et al., "Family Adenoviridae," Virus taxonomy. VIIIth report of the International Committee on Taxonomy of Viruses, 2004, Academic Press, New York, pp. 213-228.

Benson D.A., et al., "GenBank," Nucleic Acids Research, 1999, vol. 27 (1), pp. 12-17.

Berencsi G., et al., "Molecular Biological Characterization of Adenovirus DNA," Acta Microbiologica et Immunologica Hungarica, 1998, vol. 45 (3-4), pp. 297-304.

Besselsen D.G., et al., "Detection of Rodent Coronaviruses by Use of Fluorogenic Reverse Transcriptase-Polymerase Chain Reaction Analysis," Comparative Medicine, 2002, vol. 52 (2), pp. 111-116.

Bishop M.J., et al., "Molecular Sequence Databases" in: Nucleic Acid and Protein Sequence Analysis, 4th Chapter, Bishop M.J., et al., Eds, IRL Press, 1987, pp. 83-113.

Bisno A.L., "*Streptococcus Pyogenes*" in: Infectious Diseases and Their Etiologic Agents, vol. 2, Mandell, Eds., Churchill Livingston, New York, pp. 1786-1799.

Blaiotta G., et al., "PCR Detection of *Staphylococcal Enterotoxin* Genes in *Staphyiococcus* Spp. Strains Isolated from Meat and Dairy Products. Evidence for New Variants of seG and Sel in S. Aureus AB-8802," Journal of Applied Microbiology, 2004, vol. 97 (4), pp. 719-730.

BLAST Search results, Mar. 7, 2006.

Bolton E.T., et al., "A General Method for the Isolation of RNA Complementary to DNA," Proceedings of the National Academy of Sciences, 1962, vol. 48, pp. 1390-1397.

Bonk T., et al., "Matrix-Assisted Laser Desorption/Ionization Time-of-Flight Mass Spectrometry-Based Detection of Microsatellite Instabilities in Coding DNA Sequences: A Novel Approach to Identify DNA-Mismatch Repair-Deficient Cancer Cells," Clinical Chemistry, 2003, vol. 49 (4), pp. 552-561.

Borrow R., et al., "SiaD PCR Elisa for Confirmation and Identification of Serogroup Y and W135 Meningococcal Infections," FEMS Microbiology Letters, 1998, vol. 159 (2), pp. 209-214.

Boubaker K., et al., "Panton-Valentine Leukocidin and *Staphyloccocal* Skin Infections in Schoolchildren," Emerging Infectious Diseases, 2004, vol. 10 (1), pp. 121-124.

Bowers K.M., et al., "Screening for Methicillin Resistance in *Staphylococars Aureus* and Coagulasenegative *Staphylococci*: Evaluation of Three Selective and Mastalex-MRSA latex Agglutination," British Journal of Biomedical Science, 2003, vol. 60 (2), pp. 71-74.

Brakstad O.G., et al., "Direct Identification of *Staphylococcus Aureus* in Blood Cultures Bydetection of the Gene, Encoding the Thermostable Nuclease or the Gene Product," Acta Pathologica, Microbiologica et Immunologica Scandinavica, 1995, vol. 103 (3), pp. 209-218.

Brakstad O.G., et al., "Multiplex Polymerase Chain Reaction for Detection of Genes for *Staphylococcus Aureus* Themonuclease and Methicillin Resistance and Correlation with Oxacillin Resistance," Acta Pathologica, Microbiologica et Immunologica Scandinavica, 1993, vol. 101 (9), pp. 681-688.

Brandt C.D., et al., "Infections in 18,000 Infants and Children in a Controlled Study of Respiratory Tract Disease. I. Adenovirus Pathogenicity in Relation to Serologic Type and Illness Syndrome," American Journal of Epidemiology, 1969, vol. 90 (6), pp. 484-500.

Brayshaw D.P., "Methicillin-Resistant Staphylococcus Aureus: Evaluation of Detection Techniques on Laboratory-Passaged Organisms," British Journal of Biomedical Science, 1999, vol. 56 (3), pp. 170-176.

Brightwell G., et al., "Development of Internal Controls for PCR Detection of *Bacillus Anthracis*," Molecular and Cellular Probes, 1998, vol. 12 (6), pp. 367-377.

Brightwell G., et al., "Genetic Targets for the Detection and Identifiaction of Venezuelan Equine Encephalitis Viruses," Archives of Virology, 1998, vol. 143 (4), pp. 731-742.

Bronzoni R.V.M., et al., "Duplex Reverse Transcription-PCR Followed by Nested PCR Assays for Detection and Identification of Brazilian Alphaviruses and Flaviviruses," Journal of Clincal Microbiology, 2005, vol. 43 (2), pp. 696-702.

Bronzoni R.V.M., et al., "Multiplex Nested PCR for Brazilian Alphavirus Diagnosis," Transactions of the Royal Society of Tropical Medicine and Hygiene, 2004, vol. 98 (8), pp. 456-461.

Brown I.H., "Advances in Molecular Diagnostics for Avian Influenza," Developments in Biologicals, 2006, vol. 124, pp. 93-97.

Brownstein M.J., et al., "Modulation of Non-Templated Nucleotide Addition by Taq DNA Polymerase: Primer Modifications that Facilitate Genotyping," BioTechniques, 1996, vol. 20 (6), pp. 1004-1010.

Brunaud V., et al., "T-DNA Integration into the Arabidopsis Genome Depends on Sequence of Pre-Insertion Sites," EMBO Reports, 2002, vol. 3 (12), pp. 1152-1157.

Buetow K.H., et al., "High-Throughput Development and Characterization of a Genomewide Collection of Gene-Based Single Nucleotide Polymorphism Markers by Chip-Based Matrix-Assisted Laser Desorption/Ionization Time-of-Flight Mass Spectrometry," Proceedings of the National Academy of Sciences, 2001, vol. 98 (2), pp. 581-584.

Butel J.S., et al., "Cell and Molecular Biology of Simian Virus 40: Implications for Human Infections and Disease," Journal of the National Cancer Institute, 1999, vol. 91 (2), pp. 119-134.

Butler J., "DNA Profiling and Quantitation of Human DNA," CCQM Bio Analysis Working Group, 2005.

Butler J.M., et al., High Throughput Genotyping of Forensic STRs and SNPs using Time-of-Flight Mass Spectrometry, 9th International Symposium on Human Identification, 1998, Orlando FL.

Carracedo A., et al., "DNA Commission of the International Society for Forensic Genetics: Guidelines Formitochondrial DNA Typing," Forensic Science International, 2000, vol. 110 (2), pp. 79-85.

Carroll K.C., et al., "Rapid Detection of the *Staphylococcal mecA* Gene from BACTEC BloodCulture Bottles by the Polymerase Chain Reaction," American Journal of Clincal Pathology, 1996, vol. 106 (5), pp. 600-605.

Case J.T., et al., "Maternal Inheritance of Mitochondrial DNA Polymorphisms in Cultured Human Fibroblasts," Somatic Cell Genetics, 1981, vol. 7 (1), pp. 103-108.

Cattoli G., et al., "Comparison of Three Rapid Detection Systems for Type A Influenza Virus on Tracheal Swabs of Experimentally and Naturally Infected Birds," Avian Pathology, 2004, vol. 33 (4), pp. 432-437.

Cavassin I M., et al., "Evaluation of MRSA-Screen, a Simple Anti-Pbp 2a Slide Latex AgglutinationKit, for Rapid Detection of Methicillin Resistance in *Staphylococcus aureus*," Journal of Clincal Microbiology, 1999, vol. 37 (5), pp. 1591-1594.

Certificate of Correction mailed Jan. 6, 2009 for U.S. Appl. No. 10/660,996, filed Sep. 12, 2003.

Certificate of Correction mailed Aug. 7, 2007 for U.S. Appl. No. 10/660,997, filed Sep. 12, 2003.

Certificate of Correction mailed Dec. 12, 2006 for U.S. Appl. No. 10/156,608, filed May 24, 2002.

Certificate of Correction mailed Jul. 17, 2007 for U.S. Appl. No. 09/891,793, filed Jun. 26, 2001.

Certificate of Correction mailed Mar. 31, 2008 for U.S. Appl. No. 09/891,793, filed Jun. 26, 2001.

Certificate of Correction mailed Mar. 31, 2008 for U.S. Appl. No. 10/156,608, filed May 24, 2002.

Certificate of Correction mailed Mar. 31, 2008 for U.S. Appl. No. 10/660,997, filed Sep. 12, 2003.

Chamberlin M., et al., "New RNA Polymerase from *Escerichia Coli* Infected with Bacteriophage T7," Nature, 1970, vol. 228 (5268), pp. 227-231.

Chandra S., et al., "Virus Reduction in the Preparation and Intravenous Globulin: In Vitro Experiments," Transfusion, 1999, vol. 39 (3), pp. 249-257.

Chang P.K., et al., "aflT, a MFS Transporter-Encoding Gene Located in the Aflatoxin Gene Cluster, does not have a Significant Role in Aflatoxin Secretion," Fungal Genetics and Biology, 2004, vol. 41 (10), pp. 911-920.

Chaves F., et al., "Molecular Characterization of Resistance to Mupirocin in Methicillin-Susceptible and -Resistant Isolates of *Staphylococcus aureus* from Nasal Samples," Journal of Clincal Microbiology, 2004, vol. 42 (2), pp. 822-824.

Chelly J., et al., "Transcription of the Dystrophin Gene in Human Muscle and Non-Muscle Tissue," Nature, 1988, vol. 333 (6176), pp. 858-860.

Chen C.H., et al., Laser Desorption Mass Spectrometry for FastDNA Sequencing [online], Nov. 1994, Retrieved from the Internet< URL:http://www.ornl.gove/sci/techresources/Human_Genome/publicat/94SANTA/sequencing/seqtoc.shtml>.

Chen N., et al., "The Genomic Sequence of Ectromelia Virus, the Causative Agent of Mousepox," Virology, 2003, vol. 317 (1), pp. 165-186.

Chen R., et al., "Trapping, Detection, and Charge and Mass Measurement of Large Individual Ions (up to 1.1 X 108 Daltons) by Electrospray Ionization FTICR MS," 42nd ASMS Conference on Mass Spectrometry, 1994.

Chen Y.Z., et al., "A BAC-Based STS-Content Map Spanning a 35-Mb Region of Human Chromosome 1p35-36," Genomics, 2001, vol. 74 (1), pp. 55-70.

Chen Z., et al., "Genetic Mapping of the Cold-Adapted Phenotype of B/Ann Arbor/1/66, the Master Donor Virus for Live Attenuated Influenza Vaccines (FluMist)," Virology, 2006, vol. 345 (2), pp. 416-423.

Chiu N. H., et al., "Mass Spectrometry of Single-Stranded Restriction Fragments Captured by an Undigested Complementary Sequence," Nucleic Acids Research, 2000, vol. 28 (8), pp. E31.

Chmielewicz B., et al., "Development of a PCR-Based Assay for Detection, Quantification, and Genotyping of Human Adenoviruses," Clinical Chemistry, 2005, vol. 51 (8), pp. 1365-1373.

Choi S., et al., "Real-Time PCR Quantification of Human Adenoviruses in Urban Rivers Indicates Genome Prevalence but Low Infectivity," Applied and Environmental Microbiology, 2005, vol. 71 (11), pp. 7426-7433.

Choi Y.K., et al., "Detection and Subtying of Swine Influenza H1N1, H1 N2 and H3N2 Viruses in Clinical Samples Using Two Multiplex RT-PCR Assays," Journal of Virological Methods, 2002, vol. 102 (1-2), pp. 53-59.

Christel L.A., et al., "Rapid, Automated Nucleic Acid Probe Assays Using Silicon Microstructures for Nucleic Acid Concentration," Journal of Biomechanical Engineering, 1999, vol. 121 (1), pp. 22-27.

Claas E.C., et al., "Internally Controlled Real-Time PCT Monitoring of Adenovirus DNA Load inSerum or Plasma of Transplant Recipients," Journal of Clincal Microbiology, 2005, vol. 43 (4), pp. 1738-1744.

Cloney L., et al., "Rapid Detection of mecA in Methicillin Resistant *Staphylococcus Aureus* Using Cycling Probe Technology," Molecular and Cellular Probes, 1999, vol. 13 (13), pp. 191-197.

Collins D.W., et al., "Numerical Classification of Coding Sequences," Nucleic Acids Research, 1992, vol. 20 (6), pp. 1405-1410.

Contreras-Salazar B., et al., "Up Regulation of the Epstein-Barr Virus (EBV)- Encoded Membrane Protein LMP in the Burkitt's Lymphoma Line Daudi after Exposure to N-Butyrate and after EBV Superinfection," Journal of Virology, 1990, vol. 64 (11), pp. 5441-5447.

Co-pending U.S. Appl. No. 10/521,662, filed on Jul. 21, 2003.
Co-pending U.S. Appl. No. 10/754,415, filed on Jan. 9, 2004.
Co-pending U.S. Appl. No. 10/807,019, filed on Mar. 24, 2004.
Co-pending U.S. Appl. No. 10/845,052, filed on May 12, 2004.
Co-pending U.S. Appl. No. 10/964,571, filed on Oct. 12, 2004.
Co-pending U.S. Appl. No. 11/209,439, filed on Aug. 23, 2005.
Co-pending U.S. Appl. No. 11/674,538, filed on Feb. 13, 2007.
Co-pending U.S. Appl. No. 11/682,259, filed on Mar. 5, 2007.
Co-pending U.S. Appl. No. 11/929,910, filed on Oct. 30, 2007.
Co-pending U.S. Appl. No. 11/930,108, filed on Oct. 31, 2007.
Co-pending U.S. Appl. No. 11/930,741, filed on Oct. 31, 2007.
Co-pending U.S. Appl. No. 90/010,209, filed on Jun. 27, 2008.
Co-pending U.S. Appl. No. 90/010,210, filed on Jun. 27, 2008.
Co-pending U.S. Appl. No. 90/010,447, filed on Apr. 9, 2009.
Co-pending U.S. Appl. No. 90/010,448, filed on Apr. 9, 2009.
Co-pending U.S. Appl. No. 60/639,068, filed on Dec. 22, 2004.
Co-pending U.S. Appl. No. 60/648,188, filed on Jan. 28, 2005.
Co-pending U.S. Appl. No. 60/369,405, filed on Apr. 1, 2002.
Co-pending U.S. Appl. No. 60/397,365, filed on Jul. 19, 2002.
Co-pending U.S. Appl. No. 60/431,319.
Co-pending U.S. Appl. No. 60/443,443, filed on Jan. 29, 2003.
Co-pending U.S. Appl. No. 60/443,788.
Co-pending U.S. Appl. No. 60/447,529, filed on Feb. 14, 2003.
Co-pending U.S. Appl. No. 60/453,607, filed on Mar. 10, 2003.
Co-pending U.S. Appl. No. 60/461,494.
Co-pending U.S. Appl. No. 60/470,175, filed on May 12, 2003.
Co-pending U.S. Appl. No. 60/501,926, filed on Sep. 11, 2003.
Co-pending U.S. Appl. No. 60/509,911.
Co-pending U.S. Appl. No. 60/604,329, filed on Aug. 24, 2004.
Co-pending U.S. Appl. No. 60/615,387.
Co-pending U.S. Appl. No. 60/701,404, filed on Jul. 21, 2005.
Co-pending U.S. Appl. No. 60/705,631, filed on Aug. 3, 2005.
Co-pending U.S. Appl. No. 60/720,843, filed on Sep. 27, 2005.
Co-pending U.S. Appl. No. 60/747,607, filed on May 18, 2006.
Co-pending U.S. Appl. No. 60/771,101, filed on Feb. 6, 2006.
Co-pending U.S. Appl. No. 60/773,124, filed on Feb. 13, 2006.
Co-pending U.S. Appl. No. 60/891,479.
Co-pending U.S. Appl. No. 60/941,641.

Couto I., et al., "Development of Methicillin Resistance in Clinical Isolates of *Staphylococcus Sciuri* by Transcriptional Activation of the mecA Homologue Native to the Species," Journal of Bacteriology, 2003, vol. 185 (2), pp. 645-653.

Crawford-Miksza L., et al., "Analysis of 15 Adenovirus Hexon Proteins Reveals the Location and Structure of Seven Hypervariable Regions Containing Serotype-Specific Residues," Journal of Virology, 1996, vol. 70 (3), pp. 1836-1844.

Crawford-Miksza L.K., et al., "Adenovirus Serotype Evolution is Driven by Illegitimate Recombination in the Hypervariable Regions of the Hexon Protein," Virology, 1996, Vol. 224 (2), pp. 357-367. .

Crawford-Miksza L.K., et al., "Strain Variation in Adenovirus Serotypes 4 and 7a Causing Acute Respiratory Disease," Journal of Clincal Microbiology, 1999, vol. 37 (4), pp. 1107-1112.

Crespillo M., et al., "Mitochondrial DNA Sequences for 118 Individuals from Northeastern Spain," International Journal of Legal Medicine, 2000, vol. 114 (1-2), pp. 130-132.

Cui L., et al., "Contribution of a Thickened Cell Wall and Its Glutamine Nonamidated Component to the Vancomycin Resistance Expressed by *Staphylococcus Aureus* Mu50," Antimicrobial Agents and Chemotherapy, 2000, vol. 44 (9), pp. 2276-2285.

De Jong J.C., et al., "Adenoviruses from Human Immunodeficiency Virus-Infected Individuals, Including Two Strains that Represent New Candidate Serotypes Ad50 and Ad51 of Species B1 and D, Respectively," Journal of Clincal Microbiology, 1999, vol. 37 (12), pp. 3940-3945.

De La Puente-Redondo V.A., et al., "Comparison of Different PCR Approaches for Typing of *Francisella Tularensis* Strains," Journal of Clinical Microbiology, 2000, vol. 38 (3), pp. 1016-1022.

Del Blanco Garcia N., et al., "Genotyping of *Francisella Tularensis* Strains by Pulsed-field gel Electrophoresis, Amplified Fragment Length Polymorphism Fingerprinting, and 16S rRNA gene Sequencing," Journal of Clinical Microbiology, 2002, vol. 40 (8), pp. 2964-2972.

Del Vecchio V.G., et al., "Molecular Genotyping of Methicillin-Resistant *Staphylococcus aureus* via Fluorophore-Enhanced Repetitive-Sequence PCR," Journal of Clincal Microbiology, 1995, vol. 33 (8), pp. 2141-2144.

Denis M., et al., "Development of a Semiquantitative PCR Assay Using Internal Standard and Colorimetricdetection on Microwell Plate for Pseudorabies Virus," Molecular and Cellular Probes, 1997, vol. 11 (6), pp. 439-448.

Deurenberg R.H., et al., "Rapid Detection of Panton-Valentine Leukocidin from Clinical Isolates of *Staphylococcus Aureus* Strains by Real-Time PCR," FEMS Microbiology Letters, 2004, vol. 240 (2), pp. 225-228.

Deurenberg R.H., et al., "The Prevalence of the Staphylococcus Aureus tst Gene among Community- and Hospital-Acquired Strains and Isolates from Wegener's Granulomatosis Patients," FEMS Microbiology Letters, 2005, vol. 245 (1), pp. 185-189.

Deyde V.M., et al., "Genomic Signature-Based Identification of Influenza A Viruses Using RT-PCR/Electro-Spray Ionization Mass Spectrometry (ESI-MS) Technology," PLoS One, 2010, vol. 5 (10), pp. e13293.

Di Guilmi a.M., et al., "Human Adenovirus Serotype 3 (Ad3) and the Ad3 fiber Protein Bind to a 130-kDa Membrane Protein on HLa Cells," Virus Research, 1995, vol. 38 (1), pp. 71-81.

Dias Neto E., et al., "Shotgun Sequencing of the Human Transcriptome with ORF Expressed Sequence Tags," Proceedings of the National Academy of Sciences, 2000, vol. 97 (7), pp. 3491-3496.

Diep B.A., et al., "Complete Genome Sequence of USA300, an Epidemic Clone of Community Acquired Meticillin-Resistant *Staphylococcus Aureus*," Lancet, 2006, vol. 367 (9512), pp. 731-739.

Donofrio J.C., et al., "Detection of Influenza A and B in Respiratory Secretions with the Polymerase Chain Reaction," PCR Methods and Applications, 1992, vol. 1 (4), pp. 263- 268.

Doty P., et al., "Strand Separation and Specific Recombination in Deoxyribonucleic Acids: Physical Chemical Studies," Proceedings of the National Academy of Sciences, 1960, vol. 46 (4), pp. 461-476.

Drosten C., et al., "Identification of a Novel Coronavirus in Patients with Severe Acute Respiratory Syndrome," New England Journal of Medicine, 2003, vol. 348 (20), pp. 1967-1976.

Ebner K., et al., "Molecular Detection and Quantitative Analysis of the Entire Spectrum of Human Adenoviruses by a Two-Reaction Real-Time PCR Assay," Journal of Clinical Microbiology, 2005, vol. 43 (7), pp. 3049-3053.

Ebner K., et al., "Typing of Human Adenoviruses in Specimens from Immunosuppressed Patients by PCR-Fragment Length Analysis and Real-Time Quantitative PCR," Journal of Clinical Microbiology, 2006, vol. 44 (8), pp. 2808-2815.

Echavarria M., et al., "Detection of Adenoviruses (AdV) in Culture-Negative EnvironmentalSamples by PCR During an AdV-Associated Respiratory Disease Outbreak," Journal of Clinical Microbiology, 2000, vol. 38 (8), pp. 2982-2984.

Echavarria M., et al., "Prediction of Severe Disseminated Adenovirus Infection by Serum PCR," Lancet, 2001, vol. 358 (9279), pp. 384-385.

Echavarria M., et al., "Rapid Detection of Adenovirus in Throat Swab Specimens by PCR During Respiratory Disease Outbreaks among Military Recruits," Journal of Clinical Microbiology, 2003, vol. 41 (2), pp. 810-812.

Echavarria M., et al., "Use of PCR to Demonstrate Presence of Adenovirus Species B, C, or F as Well as Coinfection with Two Adenovirus Species in Children with Flu-Like Symptoms," Journal of Clinical Microbiology, 2006, vol. 44 (2), pp. 625-627.

Ecker D.J., et al., "Ibis T5000: A Universal Biosensor Approach for Microbiology," Nature Reviews Microbiology, 2008, vol. 6 (7), pp. 553-558.

Ecker D.J., et al., "Rapid Identification and Strain-Typing of Respiratory Pathogens for Epidemic Surveillance," Proceedings of the National Academy of Sciences, 2005, vol. 102 (22), pp. 8012-8017.

Ecker D.J., et al., "The Ibis T5000 Universal Biosensor. An Automated Platform for Pathogen Identification and Strain Typing," Journal of the Association for Laboratory Automation, 2006, vol. 11 (6), pp. 341-351.

Edwards K.M., et al., "Adenovirus Infections in Young Children," Pediatrics, 1985, vol. 76 (3), pp. 420-424.

Ellis J.S., et al., "Molecular Diagnosis of Influenza," Reviews in Medical Virology, 2002, vol. 12 (6), pp. 375-389.

Ellis J.S., et al., "Multiplex Reverse Transcription-PCR for Surveillance of Influenza A and B Viruses in England and Wales in 1995 and 1996," Journal of Clinical Microbiology, 1997, vol. 35(8), pp. 2076-2082.

Elnifro E.M., et al., "PCR and Restriction Endonuclease Analysis for Rapid Identification of Adenovirus Subgenera," Journal of Clinical Microbiology, 2000, vol. 38 (6), pp. 2055-2061.

Elsayed S., et al., "Development and Validation of a Molecular Beacon Probe-Based Real-Time Polymerase Chain Reaction Assay for Rapid Detection of Methicillin Resistance in *Staphylococcus Aureus*," Archives of Pathology and Laboratory Medicine, 2003, vol. 127 (7), pp. 845-849.

EMBL "Arabidopsis Thaliana T-DNA Flanking Sequence, Left Border, Clone 346C06," Accession No. AJ552897, Mar. 29, 2003.

EMBL "Dog (Clone: CXX.147) Primer for STS 147, 3Δ End, Sequence Tagged Site," Accession No. L15697, Mar. 4, 2000.

EMBL "Human, muscle, Mitochondrial Mutant, 22 nt, segment 2 of 2," Accession No. S90302, Sep. 1, 2004.

EMBL "Sequence 10 from Patent US 6563025," Accession No. AR321656, Aug. 18, 2003.

EMBL "Synthetic Construct DNA, Reverse Primer for Human STS sts-AA031654 at 1p36" Accession No. AB068711, May 21, 2003.

Enright M.C., et al., "A Multilocus Sequence Typing Scheme for *Streptococcus Pneumoniae*: Identification of Clones Associated with Serious Invasive Disease," MICROBIOLOGY, 1998, vol. 144 (Pt 11), pp. 3049-3060.

Enright M.C., et al., "Multilocus Sequence Typing for Characterization of Methicillin-Resistant and Methicillin-Susceptible Clones of *Staphylococcus Aureus*," Journal of Clinical Microbiology, 2000, vol. 38 (3), pp. 1008-1015.

Enright M.C., et al., "Multilocus Sequence Typing of *Streptococcus pyogenes* and theRelationships between Emm Type and Clone," Infection and Immunity, 2001, vol. 69 (4), pp. 2416-2427.

Enright M.C., et al., "The Evolutionary History of Methicillin-Resistant *Staphylococcus Aureus* (MRSA)," Proceedings of the National Academy of Sciences, 2002, vol. 99 (11), pp. 7687-7692.

Enright M.C., "The Evolution of a Resistant Pathogen—The Case of MRSA," Current Opinion in Pharmacology, 2003, vol. 3 (5), pp. 474-479.

Eremeeva M.E., et al., "Evaluation of a PCR Assay for Quantitation of Rickettsia rickettsii and Closely Related Spotted Fever Group Rickettsiae," Journal of Clinical Microbiology, 2003, vol. 41 (12), pp. 5466-5472.

Erlich H.A., Ed., PCR Technology: Principles and Applications for DNA Amplification, W.H. Freeman and Company, 1989.

Esmans E.L., et al., "Liquid Chromatography-Mass Spectrometry in Nucleoside, Nucleotide and Modified Nucleotide Characterization," Journal of Chromatography, 1998, vol. 794, pp. 109-127.

Eugene-Ruellan G., et al., "Detection of Respiratory Syncytial Virus A and B and Parainfluenzavirus 3 Sequences in Respiratory Tracts of Infants by a Single PCR with Primers Targeted to the L-Polymerase Gene and Differential Hybridization," Journal of Clinical Microbiology, 1998, vol. 36 (3), pp. 796-801.

European Search Report for Application No. EP10175659.1, mailed on Feb. 9, 2011, 4 pages.

Evans P., et al., "Practical Algorithms for Universal DNA Primer Design: An Exercise in Algorithm Engineering," Currents in Computational Molecular Biology, 2001, pp. 25-26.

Ex Parte Re-Examination Certificate for U.S. Appl. No. 90/010,209 mailed Jul. 7, 2009.

Ex Parte Re-Examination Certificate for U.S. Appl. No. 90/010,210, mailed Dec. 28, 2010.

Ex Parte Re-Examination Certificate for U.S. Appl. No. 90/010,447 mailed Feb. 15, 2011.

Examiner Interview Summary mailed Oct. 3, 2005 for U.S. Appl. No. 10/326,046, filed Dec. 18, 2002.

Examiner Interview Summary mailed Nov. 6, 2008 for U.S. Appl. No. 10/728,486, filed Dec. 5, 2003.

Examiner Interview Summary mailed Aug. 10, 2004 for U.S. Appl. No. 09/798,007, filed Mar. 2, 2001.

Examiner Interview Summary mailed Aug. 10, 2004 for U.S. Appl. No. 09/891,793, filed Jun. 26, 2001.

Examiner Interview Summary mailed Aug. 10, 2004 for U.S. Appl. No. 10/156,608, filed May 24, 2002.

Examiner Interview Summary mailed Aug. 10, 2004 for U.S. Appl. No. 10/326,642 filed Dec. 18, 2002.

Examiner Interview Summary mailed May 19 2003 for U.S. App. No. 09/891,793 filed Jun. 26, 2001.

Examiner Interview Summary mailed Oct. 24, 2008 for U.S. Appl. No. 11/582,859 filed Oct. 17, 2006.

Examiner Interview Summary mailed Feb. 27, 2006 for U.S. Appl. No. 10/326,644, filed Dec. 18, 2002.

Examiner Interview Summary mailed Jan. 27, 2006 for U.S. Appl. No. 10/323,211 filed Dec. 18, 2002.

Examiner Interview Summary mailed May 28, 2008 for U.S. Appl. No. 10/660,998, filed Sep. 12, 2003.

Examiner Interview Summary mailed Oct. 28, 2008 for U.S. Appl. No. 11/331,987 filed, Jan. 13, 2006.

Examiner Interview Summary mailed Oct. 29, 2008 for U.S. Appl. No. 11/331,978, filed Jan. 13, 2006.

Examiner Interview Summary mailed Oct. 29, 2009 for U.S. Appl. No. 10/660,122 filed Sep. 11, 2003.

Examiner Interview Summary mailed Jul. 31, 2006 for U.S. Appl. No. 10/326,643, filed Dec. 18, 2002.

Extended European Search Opinion for Application No. EP10175659.1, mailed on Feb. 21, 2011, 5 pages.

Extended European Search Report for Application No. EP10179789.2, mailed on Mar. 22, 2011, 9 pages.

Extended European Search Report for Application No. EP10179791.8, mailed on Mar. 17, 2011, 7 pages.

Extended European Search Report for Application No. EP10179795.9, mailed on Mar. 22, 2011, 9 pages.

Facklam R., et al., "Emm Typing and Validation of Provisional M Types for Group A *Streptococci*," Emerging Infectious Diseases, 1999, vol. 5 (2), pp. 247-253.

Fang H., et al., "Rapid Screening and Identification of Methicillin-Resistant *Staphylococcus Aureus* from Clinical Samples by Selective-Broth and Real-Time PCR Assay," Journal of Clinical Microbiology, 2003, vol. 41 (7), pp. 2894-2899.

Farlow J., et al., "*Francisella Tularensis* Strain Typing Using Multiple-Locus, Variable-Number Tandem Repeat Analysis," Journal of Critical Microbiology, 2001, vol. 39 (9), pp. 3186-3192.

Farrell D.J., "The Reliability of Microscan Conventional and Rapid Panels to Identify *Staphylococcus Aureus* and Detect Methicillin Resistance: An Evaluation Using the Tube Coagulase Test and mecA PCR," Pathology, 1997, vol. 29 (4), pp. 406-410.

Fedele C.G., et al., "Multiplex Polymerase Chain Reaction for the Simultaneous Detection and Typing of Polyomavirus JC, BK and SV40 DNA in Clinical Samples," Journal of Virological Methods, 1999, vol. 82 (2), pp. 137-144.

Fedele C.G., et al., "Quantitation of Polyomavirus DNA by a Competitive Nested Polymerase Chain Reaction," Journal of Virological Methods, 2000, vol. 88 (1), pp. 51-61.

Feng P., "Impact of Molecular Biology on the Detection of Food Pathogens," Molecular Biotechnology, 1997, vol. 7 (3), pp. 267-278.

Final Office Action mailed Aug. 6, 2010 for U.S. Appl. No. 11/929,910, filed Oct. 30, 2007.

Final Office Action mailed Jul. 8, 2010 for U.S. Appl. No. 12/326,800, filed Dec. 2, 2008.

Final Office Action mailed May 12, 2010 for U.S. Appl. No. 11/674,538, filed Feb. 13, 2007.

Final Office Action mailed Apr. 14, 2011 for U.S. Appl. No. 12/049,949, filed Mar. 17, 2008.
Final Office Action mailed Oct. 14, 2009 for U.S. Appl. No. 10/943,344, filed Sep. 17, 2004.
Final Office Action mailed Nov. 17, 2009 for U.S. Appl. No. 11/582,875, filed Oct. 17, 2006.
Final Office Action mailed Feb. 18, 2010 for U.S. Appl. No. 10/754,415, filed Jan. 9, 2004.
Final Office Action mailed Nov. 20, 2009 for U.S. Appl. No. 11/331,987, filed Jan. 13, 2006.
Final Office Action mailed Jun. 23, 2010 for U.S. Appl. No. 11/930,017, filed Oct. 30, 2007.
Final Office Action mailed Feb. 26, 2009 for U.S. Appl. No. 11/582,863, filed Oct. 17, 2006.
Final Office Action mailed Jan. 30, 2009 for U.S. Appl. No. 10/844,938 filed May 12, 2004.
Fong W.K., et al., "Rapid Solid-Phase Immunoassay for Detection of Methicillin-Resistant*Staphylococcus Aureus* Using Cycling Probe Technology," Journal of Clinical Microbiology, 2000, vol. 38 (7), pp. 2525-2529.
Fox a., et al., "Identification and Detection of Bacteria: Electrospray MS-MS Versus Derivatization/GC-MS," Proceedings of the ERDEC Scientific Conference on Chemical and Biological Defense Research, Aberdeen Proving Ground, MD, Nov. 15-18, 1994, pp. 39-44.
Fox J.P., et al., "The Virus Watch Program: A Continuing Surveillance of Viral Infections in Metropolitan New York Families," American Journal of Epidemiology, 1969, vol. 89 (1), pp. 25-50.
Francois J.C., et al., "Sequence-Specific Recognition and Cleavage of Duplex DNA via Triple-Helix Formation by Oligonucleotides Covalently Linked to a Phenanthroline-Copper Chelate," Proceedings of the National Academy of Sciences, 1989, vol. 86 (24), pp. 9702-9706.
Francois P., et al., "Rapid Detection of Methicillin-Resistant *Staphylococcus Aureus* Directly from Sterile or Nonsterile Clinical Samples by a New Molecular Assay," Journal of Clinical Microbiology, 2003, vol. 41 (1), pp. 254-260.
Freiberg C., et al., "Genome-Wide mRNA Profiling: Impact on Compound Evaluation and Target Identification in Anti-Bacterial Research," Targets, 2002, vol. 1 (1), pp. 20-29.
Freymuth F., et al., "Comparison of Multiplex PCR Assays and Conventional Techniques for the Diagnostic of Respiratory Virus Infections in Children Admitted to Hospital With an Acute Respiratory Illness," Journal of Medical Virology, 2006, vol. 78 (11), pp. 1498-1504.
Freymuth F., et al., "Detection of Respiratory Syncytial Virus, Parainfluenzavirus 3, Adenovirus Andrhinovirus Sequences in Respiratory Tract of Infants by Polymerase Chain Reaction and Hybridization," Clinical and Diagnostic Virology, 1997, vol. 8 (1), pp. 31-40.
Fuerstenau S.D., et al., "Molecular Weight Determination of Megadalton DNA Electrospray Ions Using Charge Detection Time-of-flight Mass Spectrometry," Rapid Communications in Mass Spectrometry, 1995, vol. 9 (15), pp. 1528-1538.
Fujimoto T., et al., "Single-Tube Multiplex. PCR for Rapid and Sensitive Diagnosis of Subgenus B and Other Subgenera Adenoviruses in Clinical Samples," Microbiology and Immunology, 2000, vol. 44 (10), pp. 821-826.
Fujimura S., et al., "Characterization of the mupA Gene in Strains of Methicillin-Resistant *Staphylococcus aureus* with a Low Level of Resistance to Mupirocin," Antimicrobial Agents and Chemotheraphy, 2001, vol. 45 (2), pp. 641-642.
Fujimura S., et al., "Isoleucyl-tRNA Synthetase Mutations in *Staphylococcus Aureus* Clinicallsolates and In Vitro Selection of Low-Level Mupirocin-Resistant Strains," Antimicrobial Agents and Chemotheraphy, 2003, vol. 47 (10), pp. 3373-3374.
Fujioka S., et al., "Analysis of Enterovirus Genotypes using Single-Strand Conformation Polymorphisms of Polymerase Chain Reaction Product," Journal of Virological Methods, 1995, vol. 51 (2-3), pp. 253-258.
Gabriel M.N., et al., "Improved mtDNA Sequence Analysis of Forensic Remains using a "Mini-Primer Set" Amplification Strategy," Journal of Forensic Sciences, 2001, vol. 46 (2), pp. 247-253.

Gall J.G., et al., "Construction and Characterization of Hexon-Chimeric Adenoviruses: Specification of Adenovirus Serotype," Journal of Virology, 1998, vol. 72 (12), pp. 10260-10264.
Gammelin M., et al., "Two Subtypes of Nucleoproteins (NP) of Influenza A Viruses," Virology, 1989, vol. 170 (1), pp. 71-80.
Garcia S., et al., "Quantitative Real-Time PCR Detection of Rift Valley Fever Virus and Its Application to Evaluation of Antiviral Compounds," Journal of Clinical Microbiology, 2001, vol. 39 (12), pp. 4456-4461.
Garcia-Martinez J., et al., "Use of the 16s-23s Ribosomal Genes Spacer Region in Studies of Prokaryotic Diversity," Journal of Microbiological Methods, 1999, vol. 36 (1-2), pp. 55-64.
Gattermann N., et al., "Heteroplasmic Point Mutations of Mitochondrial DNA Affecting Subunit I of Cytochrome c Oxidise in Two Patients with Acquired Idiopathic Siderblastic Anemia," Blood, 1997, vol. 90 (12), pp. 4961-4972.
Gaydos C.A., et al., "Adenovirus Vaccines in the U.S. Military," Military Medicine, 1995, vol. 160 (6), pp. 300-304.
Geha D.J., et al., "Multiplex PCR for Identification of Methicillin-Resistant *Staphylococci* in the Clinical Laboratory," Journal of Clinical Microbiology, 1994, vol. 32 (7), pp. 1768-1772.
Genbank, "{Deletion 6} [Human, Muscle, Mitochondrial Mutant, 22 nt, Segment 2 of 2]," Accession No. S90302.1, Jun. 10, 1992.
Genbank, "Acinetobacter Genomosp. 10 Strain CIP 70.12 RNA Polymerase Subunit B (rpoB) Gene, Complete Cds," Accession No. 78099429, Mar. 11, 2006.
Genbank, "Bovine Parainfluenza Virus 3 Strain Shipping Fever, Complete Genome," Accesion No. AF178655, Sep. 19, 2000.
Genbank, "Clostridium Tetani E88, Complete Genome," Accession No. AE015927.1, Feb. 4, 2003.
Genbank, "*E. coli* Operon rpoBC Coding for the Beta- and Beta"-Subunits of RNA Polymerase (Genes rpoC and rpoB), and Genes rplL, rlpJ, rplA, and rplK Coding for 50S Ribosomal Subunit Proteins L7/L12, L10, L1, and L11, Respectively. (Map position 89-90 min), Accession No. 42813, Feb. 28, 1992.
Genbank, "*E.coli* 16S Ribosomal RNA," Accession No. 174375, Aug. 11, 1995.
Genbank, "*E.coli* Open Reading Frame Upstream of Leu Operon," Accession No. M21150, Sep. 15, 1990.
Genbank, "*E.coli* rRNA Operon (rrnB) Coding for Glu-tRNA-2, 5S, 16S and 23S rRNA," Accession No. 147581, Sep. 14, 1992.
Genbank, "*Enterococcus Malodoratus* Strain ATCC43197 Elongation Factor Tu (tufA) Gene, Partial Cds," Accession No. AF274728, Dec. 11, 2000.
Genbank "*Escherichia Coli* str. K-12 substr. MG1655, Complete Genome," Accession No. NC000913, Oct. 15, 2001.
Genbank, "Homo Sapiens Haplotype V Mitochondrion, Complete Genome", Accession No. AF381990.1, Dec. 28, 2001.
Genbank, "Human Adenovirus Type 4 Hexon Gene," for Accession No. X84646, Jun. 30, 1995.
Genbank "Human Coronavirus 229E, Complete Genome," Accession No. 002645, Jul. 11, 2001.
Genbank, "Human Coronavirus 229E, Complete Genome," Accession No. AF304460, Jul. 11, 2001.
Genbank, "Human Isolate L34 Mitochondrion D-loop Region", Accession No. U08081.1, Aug. 16, 1994.
GenBank, "il11b08.y1 Human insulinoma Homo sapiens cDNA clone IMAGE:6029534 5-similar to SW:COX3_Human P00414 Cytochrome C Oxidase Polypeptide III ;, mRNA sequence", Accession No. BQ581956.1, Jun. 20, 2002.
Genbank, "Influenza B Virus B/Panama/45/90 Polymerase (PB2) mRNA, Complete Cds", Accession No. AF005737, Oct. 4, 1997, pp. 1-3.
Genbank, "Mastadenovirus h7 Hexon Gene," Accession No. Z48571, Apr. 18, 2005.
GenBank, "or72a01.s1 NCI_CGAP_Lu5 Homo sapiens cDNA Clone IMAGE:1601352 3-similar to SW:COX1_Human P00395 Cytochrome C Oxidase Polypeptide I ;, mRNA sequence", Accession No. AI002209.1, Jun. 10, 1998.
Genbank "*Staphylococcus Aureus* RN4220 ErmC Gene, Partial Cds," Accession No. 18542231, Sep. 16, 2003.
Genbank "*Staphylococcus Aureus* Strain MSSA476, Complete Genome," Accession No. BX571857.1, Jun. 24, 2004.

Genbank, "*Staphylococcus Aureus* Subsp. Aureus Mu50, Complete Genome," Accession No. 15922990, Oct. 4, 2001.
Genbank "*Staphylococcus Aureus* Subsp. Aureus MW2, Complete Genome," Accession No. GI21281729, May 31, 2002.
Genbank, "*Staphylococcus Epidermidis* ATCC 12228, Complete Genome," Accession No. AE015929.1, Jan. 2, 2003.
Genbank "*Streptococcus Agalactiae* 2603V/R, Complete Genome," Accession No. AE009948.1, Aug. 28, 2002.
Genbank, "*Streptococcus Anginosus* Elongation Factor Tu (tuf) Gene, Partial cds," Accession No. AF276257.1, Jul. 1, 2001.
Genbank, "*Streptococcus Pneumoniae* Isolate 95.1In00S DNA Gyrase Subunit B (gyrB) Gene, Complete Cds," Accession No. 73916349, Sep. 30, 2005.
Genbank, "*Streptococcus Pyogenes* Strain MGAS8232, Complete Genome," Accession No. AE009949.1, Apr. 3, 2002.
Genbank, "Venezuelan Equine Encephalitis Virus Nonstructural Polyprotein and Structural Polyprotein Genes, Complete Cds," Accession No. AF375051.1, Jun. 26, 2001.
Gendel S.M., "Computational Analysis of the Specificity of 16S rRNA-Derived Signature Sequencesfor Identifying Food-Related Microbes," Food Microbiology, 1996, vol. 13, pp. 1-15.
Gibb T.R., et al., "Development and Evaluation of a 5Δ Fluorogenic Nuclease Assay to Detect and Differentiate Between Ebola Virus Subtypes Zaire and Sudan," Journal of Clinical Microbiology, 2001, vol. 39 (11), pp. 4125-4130.
Gilbert N., et al., "Comparison of Commercial Assays for the Quantitation of HBV DNA Load in Healthcare Workers: Calibration Differences," Journal of Virological Methods, 2002, vol. 100 (1-2), pp. 37-47.
Giles R.E., et al., "Maternal Inheritance of Human Mitochondrial DNA," Proceedings of the National Academy of Sciences, 1980, vol. 77 (11), pp. 6715-6719.
Gill S.R., et al., "Insights on Evolution of Virulence and Resistance from the Complete Genome Analysis of an Early Methicillin-Resistant *Staphylococcus Aureus* Strain and a Biofilm-Producing Methicillin-Resistant *Staphylococcus Epidemidis* Strain," Journal of Bacteriology, 2005, vol. 187 (7), pp. 2426-2438.
Gilliland G., et al., "Analysis of Cytokine mRNA and DNA: Detection and Quantitation by Competitive Polymerase Chain Reaction," Proceedings of the National Academy of Sciences, 1990, vol. 87 (7), pp. 2725-2729.
Ginther C., et al., "Identifying Individuals by Sequencing Mitochondrial DNA from Teeth," Nature Genetics, 1992, vol. 2 (2), pp. 135-138.
Gjoen K.V., et al., "Specific Detection of Coxsackie Viruses A by the Polymerase Chain Reaction," Clinical and Diagnostic Virology, 1997, vol. 8 (3), pp. 183-188.
Golden M.R., et al., "Pilot Study of COBAS PCR and Ligase Chain Reaction for Detection of Rectal Infections Due to *Chlamydia Trachomatis*," Journal of Clinical Microbiology, 2003, vol. 41 (5), pp. 2174-2175.
Goto K., et al., "Applications of the Partial 16S rDNA Sequence as an Index for Rapid Identification of Species in the Genus Bacillus," Journal of General and Applied Microbiology, 2000, vol. 46 (1), pp. 1-8.
Gravet a., et al., "Characterization of a Novel Structural Member, LukE-LukD, of the Bi-Component *Staphylococcal Leucotoxins* Family," FEBS Letters, 1998, vol. 436 (2), pp. 202-208.
Gray G.C., et al., "Adult Adenovirus Infections: Loss of Orphaned Vaccines Precipitates Military Respiratory Disease Epidemics," Clinical Infectious Diseases, 2000, vol. 31, pp. 663-670.
Greenberg B.D., et al., "Intraspecific Nucleotide Sequence Variability Surrounding the Origin of Replicationin Human Mitochondrial DNA," Gene, 1983, vol. 21, pp. 33-49.
Griffin T.J., et al., "Single-Nucleotide Polymorphism Analysis by Maldi-TOF Mass Spectrometry," Trends in Biotechnology, 2000, vol. 18 (2), pp. 77-84.
Grondahl B., et al., "Rapid Identification of Nine Microorganisms Causing Acute Respiratory TractInfections by Single-Tube Multiplex Reverse Transcription-PCR: Feasibility Study," Journal of Clinical Microbiology, 1999, vol. 37 (1), pp. 1-7.

Grundmann H., et al., "Emergence and Resurgence of Meticillin-Resistant *Staphylococcus Aureus* as a Public-Health Threat," Lancet, 2006, vol. 368 (9538), pp. 874-885.
Grzybowski T., et al., "Extremely High Levels of Human Mitochondrial DNA Heteroplasmy in Single Hair Roots," Electrophoresis, 2000, vol. 21 (3), pp. 548-553.
Gu Z., et al., "Multiplexed, Real-Time PCR for Quantitative Detection of Human Adenovirus," Journal of Clinical Microbiology, 2003, vol. 41 (10), pp. 4636-4641.
Guatelli J.C., et al., "Nucleic Acid Amplification In Vitro: Detection of Sequences with Low Copy Numbers and Application to Diagnosis of Human Immunodeficiency Virus Type 1 Infection," Clinical Microbiology Reviews, 1989, vol. 2 (2), pp. 217-226.
Gut M., et al., "One-Tube Fluorogenic Reverse Transcription-Polymerase Chain Reaction for the Quantitation of Feline Coronaviruses," Journal of Virological Methods, 1999, vol. 77 (1), pp. 37-46.
Haff L.A., et al., "Multiplex Genotyping of PCR Products with Mass Tag-Labeled Primers," Nucleic Acids Research, 1997, vol. 25 (18), pp. 3749-3750.
Hahner S., et al., "Analysis of Short Tandem Repeat Polymorphisms by Electrospray Ion Trap Mass Spectrometry," Nucleic Acids Research, 2000, vol. 28 (18), pp. E82.1-E82.8.
Haines J.D., et al., "Medical Response to Bioterrorism: Are We Prepared," Journal of Oklahoma State Medical Association, 2000, vol. 93, pp. 187-196.
Hall T.A., et al., "Base Composition Analysis of Human Mitochondrial DNA Using Electrospray Ionization Mass Spectrometry: A Novel Tool for the Identification and Differentiation of Humans," Analytical Biochemistry, 2005, vol. 344 (1), pp. 53-69.
Hamdad F., et al., "Detection of Methicillin/Oxacillin Resistance and Typing in Aminoglycoside-Susceptible Methicillin-Resistant and Kanamycin-Tobramycin-Resistant Methicillin-Susceptible," Microbial Drug Resistance, 2006, vol. 12 (3), pp. 177-185.
Hamel S., et al., "Consensus PCR and Microarray for Diagnosis of the Genus *Staphylococcus*, Species, and Methicillin Resistance," Biotechniques, 2001, vol. 31 (6), pp. 1364-1372.
Hammerle T., et al., "A Sensitive PCR Assay System for the Quantitation of Viral Genome Equivalents:Hepatitis C Virus (HCV)," Archives of Virology, 1996, vol. 141 (11), pp. 2103-2114.
Hannis J.C., et al., "Nanoelectrospray Mass Spectrometry Using Non-Metalized, Tapered (50-10 .mu.m) Fused-silica Capillaries," Rapid Communication in Mass spectrometry, 1998, vol. 12, pp. 443-448.
Hanssen a.M., et al., "*Sccmecin Staphylococci*: Genes on the Move," FEMS Immuol Medical Microbiol, 2006, vol. 46, pp. 8-20.
Hasebe F. et al., "Combined Detection and Genotyping of Chikungunya Virus by a Specific Reverse Transcription-Polymerase Chain Reaction," Journal of Medical Virology, 2002, vol. 67 (3), pp. 370-374.
Hassan a.A., et al., "Inter- and Intraspecies Variations of the 16S-23S rDNA Intergenic Spacer Region of Various *Streptococcal* Species," Systematic and Applied Microbiology, 2003, vol. 26 (1), pp. 97-103.
Haugland R.A., et al., "Identification of Putative Sequence Specific PCR Primers for Detection of the Toxygenic Fungal Species *Stachybotrys Chartarum*," Molecular and Cellular Probes, 1998, vol. 12 (6), pp. 387-396.
He L., et al, "Development of a Capillary High-performance Liquid Chromatography Tandem Mass Spectrometry System Using SWIFT Technology in an Ion Trap/Reflectron Time-of-flight Mass Spetrometer," Biochemical and Biophysical Research Communications, 1997, vol. 11, pp. 1739-1748.
Heim A., et al., "Rapid and Quantitative Detection of Human Adenovirus DNA by Real-Time PCR," Journal of Medical Virology, 2003, vol. 70, pp. 228-239.
Herrmann B., et al., "Differentiation of *Chiamydia* spp. By Sequence Determination and Restriction Endonuclease Cleavage of RNase P RNA Genes," Journal of Clinical Microbiology, 1996, vol. 34 (8), pp. 1897-1902.
Higgins J.A., et al., "Sensitive and Rapid Identification of Biological Threat Agents," Annals of the New York Academy of Sciences, 1999, vol. 894, pp. 130-148.

Hill F., et al., "Polymerase Recognition of Synthetic Oligodeoxyribonucleotides Incorporating Degenerate Pyrimidine and Purine Bases," Proceedings of the National Academy of Sciences, 1998, vol. 95, pp. 4258-4263.

Hiramatsu K., et al., "The Emergence and Evolution of Methicillin-Resistant Staphylococcusaureus," Trends Microbiology, 2001, vol. 9 (10), pp. 486-493.

Hodgson J.E., et al., "Molecular Characterization of the Gene Encoding High-Level Mupirocin Resistancein Staphylococcus aureus J2870," Antimicrobial Agents and Chemotherapy, 1994, vol. 38 (5), pp. 1205-1208.

Hoffman E., et al., "Rescue of Influenza B Virus from Eight Plasmids," Proceedings of the National Academy of Sciences, 2002, vol. 99 (17), pp. 11411-11416.

Hofstadler S.A., et al., "TIGER: The Universal Biosensor," International Journal of Mass Spectrometry, 2005, vol. 242, pp. 23-41.

Holden M.T., et al., "Complete Genomes of Two Clinical Staphylocuccus Aureus Strain: Evidence for the Rapid Evolution of Virulence and Drug Resistance," Proceedings of the National Academy of Sciences, 2004, vol. 101 (26), pp. 9786-9791.

Holland M.M., et al., "Mitochondrial DNA Sequence Analsysis—Validation and Use for Forensic Casework," Forensic Science Review, 1999, vol. 11 (1), pp. 22-50.

Holland M.M., et al., "Mitochondrial DNA Sequence Analysis of Human Skeletal Remains: Identification of Remains from the Vietnam War," Journal of Forensic Sciences, 1993, vol. 38 (3), pp. 542-553.

Holm L., et al., "Removing Near-Neighbour Redundancy from Large Protein Sequence Collections," Bioinformatics, 1998, vol. 14 (5), pp. 423-429.

Holmes E.C., et al., "Whole-Genome Analysis of Human Influenza A Virus Reveals Multiple Persistent Lineages and Reassortment among Recent H3N2 Viruses," Public Library of Science Biology, 2005, vol. 3 (9), pp. 1579-1589.

Hood E., et al., "Chemical and Biological Weapons: New Questions, New Answers," Environmental Health Perspectives, 1999, vol. 107 (12), pp. 931-932.

Houng H.S., et al., "Rapid Type-Specific Diagnosis of Adenovirus Type 4 Infection Using a Hexon-Based Quantitative Fluorogenic PCR," Diagnostic Microbiology and Infectious Disease, 2002, vol. 42 (4), pp. 227-236.

Howell N., et al., "Persistent Heteroplasmy of a Mutation in the Human mtDNA Control Region: Hypermutation as an Apparent Consequence of Simple-Repeat Expansion/Contraction," American Journal of Human Genetics, 2000, vol. 66 (5), pp. 1589-1598.

Huber C.G., et al., "On-Line Cation Exchange for Suppression of Adduct Formation in Negative-Ion Electrospray Mass Spectrometry of Nucleic Acids," Analytical Chemistry, 1998, vol. 70 (24), pp. 5288-5295.

Huletsky a., et al., "New Real-Time PCR Assay for Rapid Detection of Methicillin-Resistantstaphylococcus Aureus Directly from Specimens Containing a Mixture of Staphylococci," Journal of Clinical Microbiology, 2004, vol. 42 (5), pp. 1875-1884.

Hunag C., et al., "Detection of Arboviral RNA Directly from Mosquito Homogenates by Reverse Transcription-Polymerase Chain Reaction," Journal of Virological Methods, 2001, vol. 94 (1-2), pp. 121-128.

Hurdle J.G., et al., "Analysis of Mupirocin Resistance and Fitness in Staphylococcus aureus by Molecular Genetic and Structural Modeling Techniques," Antimicrobial Agents and Chemotherapy, 2004, vol. 48 (11), pp. 4366-4376.

Hutchison C.A., et al., "Maternal Inheritance of Mammalian Mitochondrial DNA," Nature, 1974, vol. 251 (5475), pp. 536-538.

Hyde-Deruyscher R., et al., "Polyomavirus Early-Late Switch is not Regulated at the Level of Transcription Initiation and is associated with changes in RNA Processing," Proceedings of the National Academy of Sciences, 1988, vol. 85, pp. 8993-8997.

Ieven M., et al., "Rapid Detection of Methicillin Resistance in Coagulase-Negative Staphylococci by Commercially Available Fluorescence Test," Journal of Clinical Microbiology, 1995, vol. 33 (8), pp. 2183-2185.

Ihle O., et al., "Efficient Purification of DNA Fragments using a Protein Binding Membrane," Nucleic Acids Research, 2000, vol. 28 (16), p. e76.

Inglis T.J., et al., "Rapid Genotypic Confirmation of Methicillin Resistance," Pathology, 1996, vol. 28 (3), pp. 259-261.

Ingman M., et al., "Mitochondrial Genome Variation and the Origin of Modern Humans," Nature, 2000, vol. 408 (6813), pp. 708-713.

International Preliminary Examination Report for Application No. PCT/US2002/06763, mailed on Jun. 11, 2003, 6 pages.

International Preliminary Examination Report for Application No. PCT/US2002/20336, mailed on Apr. 26, 2004, 8 pages.

International Preliminary Examination Report for Application No. PCT/US2003/09802, mailed on Apr. 8, 2005, 7 pages.

International Preliminary Examination Report for Application No. PCT/US2003/22835, mailed on Mar. 5, 2005, 4 pages.

International Preliminary Examination Report for Application No. PCT/US2003/38505, mailed on Mar. 3, 2006, 5 pages.

International Preliminary Examination Report for Application No. PCT/US2003/38757, mailed on Feb. 2, 2007, 5 pages.

International Preliminary Examination Report for Application No. PCT/US2003/38761, mailed on Jun. 27, 2006, 6 pages.

International Preliminary Report on Patentability and Written Opinion for Application No. PCT/US2004/012671, mailed on Oct. 23, 2007, 7 pages International Preliminary Report on Patentability and Written Opinion for Application No. PCT/US2005/00386, mailed on Jul. 10, 2006, 6 pages.

International Preliminary Report on Patentability and Written Opinion for Application No. PCT/US2005/030058, mailed on Aug. 20, 2007, 6 pages.

International Preliminary Report on Patentability and Written Opinion for Application No. PCT/US2005/033707, mailed on Mar. 20, 2007, 6 pages.

International Preliminary Report on Patentability for Application No. PCT/US2004/033742, mailed on Jun. 20, 2006, 1 page.

International Preliminary Report on Patentability for Application No. PCT/US2006/028397, mailed on Jan. 22, 2008, 1 page.

International Preliminary Report on Patentability for Application No. PCT/US2008/054926, mailed on Aug. 26, 2009, 1 page.

International Preliminary Report on Patentability, Written Opinion and International Search Report for Application No. PCT/US2004/015123, mailed on Oct. 3, 2005, 8 pages.

International Search Report and Written Opinion for Application No. PCT/US2005/018031, mailed on Jun. 28, 2006, 14 pages.

International Search Report and Written Opinion for Application No. PCT/US2006/007747, mailed on Sep. 5, 2006, 13 pages.

International Search Report and Written Opinion for Application No. PCT/US2006/028397, mailed on Mar. 5, 2007, 14 pages.

International Search Report and Written Opinion for Application No. PCT/US2006/040747, mailed on Mar. 17, 2009, 19 pages.

International Search Report and Written Opinion for Application No. PCT/US2006/061307, mailed on Jan. 9, 2008, 21 pages.

International Search Report and Written Opinion for Application No. PCT/US2007/020045 mailed on Jan. 8, 2009, 18 pages.

International Search Report and Written Opinion for Application No. PCT/US2008/054926, mailed on Jan. 26, 2009, 15 pages.

International Search Report and Written Opinion for Application No. PCT/US2008/057901, mailed on Aug. 28, 2008, 14 pages.

International Search Report and Written Opinion for Application No. PCT/US2008/064891, mailed on Jun. 29, 2009, 15 pages.

International Search Report for Application No. PCT/US04/007236, mailed on Feb. 24, 2006, 2 pages.

International Search Report for Application No. PCT/US2002/06763, mailed on Oct. 23, 2002, 4 pages.

International Search Report for Application No. PCT/US2002/20336, mailed on Feb. 3, 2003, 4 pages.

International Search Report for Application No. PCT/US2003/009802, mailed on Aug. 3, 2004, 2 pages.

International Search Report for Application No. PCT/US2003/038505, mailed on Apr. 12, 2005, 2 pages.

International Search Report for Application No. PCT/US2003/038830, mailed on Aug. 25, 2004, 4 pages.

International Search Report for Application No. PCT/US2003/22835, mailed on Dec. 12, 2003, 1 page.
International Search Report for Application No. PCT/US2003/38757, mailed on Jun. 24, 2004, 2 pages.
International Search Report for Application No. PCT/US2003/38761, mailed on Dec. 30, 2005, 5 pages.
International Search Report for Application No. PCT/US2003/38795, mailed on Apr. 19, 2004, 3 pages.
International Search Report for Application No. PCT/US2004/012671, mailed on Sep. 28, 2007, 2 pages.
International Search Report for Application No. PCT/US2004/015123, mailed on Oct. 3, 2005, 2 pages.
International Search Report for Application No. PCT/US2004/015196, mailed on Jul. 1, 2005, 3 pages.
International Search Report for Application No. PCT/US2004/028869, mailed on Jul. 17, 2006, 4 pages.
International Search Report for Application No. PCT/US2004/033742, mailed on May 15, 2006, 2 pages.
International Search Report for Application No. PCT/US2005/000386, mailed on May 9, 2006, 3 pages.
International Search Report for Application No. PCT/US2005/005356, mailed on Aug. 7, 2007, 4 pages.
International Search Report for Application No. PCT/US2005/006133, mailed on Jul. 26, 2007, 4 pages.
International Search Report for Application No. PCT/US2005/009557, mailed on Sep. 19, 2005, 1 page.
International Search Report for Application No. PCT/US2005/018337, mailed on Oct. 10, 2006, 2 pages.
International Search Report for Application No. PCT/US2005/024799, mailed on Dec. 28, 2006, 4 pages.
International Search Report for Application No. PCT/US2005/030058, mailed on Aug. 20, 2007, 1 page.
International Search Report for Application No. PCT/US2005/033707, mailed on Feb. 6, 2006, 3 pages.
International Search Report for Application No. PCT/US2007/066194, mailed on Jan. 15, 2008, 4 pages.
International Search Report for Application No. PCT/US2008/065332, mailed on Nov. 28, 2008, 4 pages.
International Search Report for Application No. PCT/US2009/045635, mailed on Oct. 7, 2009, 9 pages.
Inyaku K., et al., "Rapid Detection and Identification of Mycobacteria in Sputum Samples by Nested Polymerase Chain Reaction and Restriction Fragment Length Polymorphisms of dnaJ Heat Shock Protein Gene," Journal of Medical Sciences, 1993, vol. 42 (1), pp. 2131.
Iqbal S.S., et al., "A Review of Molecular Recognition Technologies for Detection of Biological Threat Agents," Biosensors & Bioelectronics, 2000, vol. 15 (11-12), pp. 549- 578.
Iteman I., et al., "Comparison of Conserved Structural and Regulatory Domains within Divergent 16S rRNA-23S rRNA Spacer Sequences of Cyanobacteria," Microbiology, 2000, vol. 146 (Pt 6), pp. 1275-1286.
Ito T., et al., "Insights on Antibiotic Resistance of *Staphylococcus Aureus* from its Whole Genome: Genomic Island Scc," Drug Resistance Updates, 2003, vol. 6 (1), pp. 41-52.
Ito T., et al., "Structural Comparison of Three Types of Staphylococcal Cassette Chromosome mecIntegrated in the Chromosome in Methicillin-Resistant *Staphylococcus Aureus*," Antimicrobial Agents and Chemotherapy, 2001, vol. 45 (5), pp. 1323-1336.
Jackson P.E., et al., "Mass Spectrometry for Genotyping: an Emerging Tool for Molecular Medicine," Molecular Medicine Today, 2000, vol. 6 (7), pp. 271-276.
James a.M., et al., "*Borelia Lonestari* Infection after a Bite by an *Amblyomma Americanum* Tick," The Journal of Infectious Diseases, 2001, vol. 183 (12), pp. 1810-1814.
Jansen R.C., et al., "Genotype-by-environment Interaction in Genetic Mapping of Multiple Quantitative Trait Loci," Theoretical and Applied Genetics, 1995, vol. 91, pp. 33- 37.
Jaulhac B., et al., "Specific Detection of the Toxic Shock Syndrome Toxin-1 Gene Using the Polymerase Chain Reaction," Molecular and Cellular Probes, 1991, vol. 5, pp. 281-284.

Jaulhac B., et al., "Synthetic DNA Probes for Detection of Genes for Enterotoxins A, B, C, D, E and for Tsst-1 in *Staphylococcal* Strains," Journal of Applied Bacterial, 1992, vol. 72 (5), pp. 386-392.
Jensen M.A., et al., "Rapid Identification of Bacteria on the Basis of Polymcrase Chain Reaction-Amplified Ribosomal DNA Spacer Polymorphisms," Applied and Environmental Microbiology, 1993, vol. 59 (4), pp. 945-952.
Jeong J., et al., "Early Screening of Oxacillin-Resistant *Staphylococcus Aureus* and *Staphylococcus Epidermidis* from Blood Culture," Journal of Korean Medical Science, 2002, vol. 17, pp. 168-172.
Jiang C., et al., "Multiple Trait Analysis of Genetic Mapping for Quantitative Trait Loci Genetics," Genetics, 1995, vol. 140 (3), pp. 1111-1127.
Jiang Y., et al., "A Highly Efficient and Automated Method for Purifying and Desalting PCR Products for Analysis by Electrospray Ionization Mass Spectrometry," Analytical Biochemistry, 2003, vol. 316 (1), pp. 50-57.
Johansson A., et al., "Evaluation of PCR-based Methods for Discrimination of *Francisella* species and Subspecies and Development of a Specific PCR that Distinguishes the Two Major Subspecies of *Francisella Tularensis*," Journal of Clinical Microbiology, 2000, vol. 38 (11), pp. 4180-4185.
Johnson W.M., et al., "Detection of Genes for Enterotoxins, Exfoliative Toxins, and Toxic Shock Syndrome Toxin 1 in *Staphylococcus Aureus* by the Polymerase Chain Reaction," Journal of Clinical Microbiology, 1991, vol. 29 (3), pp. 426-430.
Johnson Y.A., et al., "Precise Molecular Weight Determination of PCR Products of the rRNA Intergenic Spacer Region Using Electrospray Quadrupole Mass Spectrometry for Differentiation of *B. Subtilis* and *B. Atrophaeus*, Closely Related Species of Bacilli," Journal of Microbiological Methods, 2000, vol. 40 (3), pp. 241-254.
Jonas D., et al., "Rapid PCR-Based Identification of Methicillin-Resistant *Staphylococcus Aureus* from Screening Swabs," Journal of Clinical Microbiology, 2002, vol. 40 (5), pp. 1821-1823.
Jurinke C., et al., "Application of Nested PCR and Mass Specctrometry for DNA Based Virus Detection: HBV-DNA Detected in the Majority of Isolated Anti-Hbc Positive Sera," Genetic Analysis: Biomolecular Engineering, 1998, vol. 14 (3), pp. 97-102.
Jurinke C., et al., "Detection of Hepatitis B: Virus DNA In Serum Samples Via Nested PCR and MALDI-TOF Mass Spectrometry," Genetic Analysis: Biomolecular Engineering, 1996, vol. 13 (3), pp. 67-71.
Jurinke C., et al., "MALDI-TOF Mass Spectrometry. A Versatile Tool for High-Performance DNA Analysis," Molecular Biotechnology, 2004, vol. 26 (2), pp. 147-163.
Kacian D.L., et al., "A Replicating RNA Molecule Suitable for a Detailed Analysis of Extracellular Evolution and Replication," Proceeding of the National Academy of Sciences, 1972, vol. 69 (10), pp. 3038-3042.
Kajon A.E., et al., "Genome Type Analysis of Brazilian Adenovirus Strains of Serotypes 1, 2, 3, 5, and 7 Collected Between 1976 and 1995," Journal of Medical, 1999, vol. 58 (4), pp. 408-412.
Kasai H., et al., "Construction of the gyrB Database for the Identification and Classification of Bacteria," Genome Informatics. Workshop on Genome Informatics, 1998, pp. 13-21.
Katano H., et al., "Identification of Adeno-Associated Virus Contamination In Cell And Virus Stocks by PCR," Biotechniques, 2004, vol. 36 (4), pp. 676-680.
Katayama Y., et al., "Genetic Organization of the Chromosome Region Surrounding mecA in Clinical *Staphylococcal* Strains: Role of IS431 -Mediated mecI Deletion in Expression of Resistance in med-Canying, Low-Level Methicillin-Resistant *Staphylococcus haemolyticus*," Antimicrobial Agents and Chemotherapy, 2001, vol. 45 (7), pp. 1955-1963.
Ke D., et al., "Development of a PCR Assay for Rapid Detection of Enterococci," Journal of Clinical Microbiology, 1999, vol. 37 (11), pp. 3497-3503.
Kearns a.M., et al., "Rapid Detection of Methicillin-Resistant *Staphylococci* by Multiplex PCR," The Journal of Hospital Inspection, 1999, vol. 43 (1), pp. 33-37.
Keller A., et al., "Empirical Statistical Model to Estimate the Accuracy of Peptide Identifications Made by MS/MS and Database Search," Analytical Chemistry, 2002, vol. 74 (20), pp. 5383-5392.

Khan A.S., et al., "An Outbreak of Crimean-Congo Haemorrhagic Fever in the United Arab Emirates, 1994-1995," The American Journal of Tropical Medicine and Hygiene, 1997, vol. 57 (5), pp. 519-525.

Khan S.A., et al., "Simultaneous Detection of Erythromycin-Resistant Methylase Genes ermA and ermC from *Staphylococcus* Spp. By Multiplex-PCR," Molecular and Cellular Probes, 1999, vol. 13 (5), pp. 381-387.

Kidd A.H., et al., "Rapid Subgenus Identification of Human Adenovirus Isolates by a General PCR," Journal of Clinical Microbiology, 1996, vol. 34 (3), pp. 622-627.

Kidd-Ljunggren K., et al., "The Hepatitis B Virus X Gene: Analysis of Functional Domain Variation and Gene Phylogeny using Multiple Sequences," Journal of General Virology, 1995, vol. 76 (pt 9), pp. 2119-2130.

Kikuchi K., et al., "Restriction Fragment Length Polymorphism Analysis of Clinical Isolates of Mycobacterium Haemophilum," Journal of Clinical Microbiology, 1994, vol. 32 (7), pp. 1763-1767.

Kilbourne E.D., "Influenza Pandemics of the 20th Century," Emerging Infectious Diseases Journal, 2006, vol. 12 (1), pp. 9-14.

Kilbourne E.D., "Influenza Pandemics: Can We Prepare for the Unpredictable," Viral Immunology, 2004, vol. 17 (3), pp. 350-357.

Kilpatrick D.R., et al., "Group-Specific Identification of Polioviruses by PCR Using Primer Containing Mixed- Base or Deoxyinosine Residues at Positions of Codon Degeneracy," Journal of Clinical Microbiology, 1996, vol. 34 (12), pp. 2990-2996.

Kim B.J., et al., "Identification of Mycobacterial Species by Comparative Sequence Analysis of the RNA Polymerase Gene (rpoB)," Journal of Clinical Microbiology, 1999, vol. 37 (6), pp. 1714-1720.

Kinney R.M., et al., "Nucleotide Sequences of the 26S mRNAs of the Viruses Defining the Venezuelan Equine Encephalitis Antigenic Complex," The American Journal of Tropical Medicine and Hygiene, 1998, vol. 59 (6), pp. 952-964.

Kirpekar F., et al., "Matrix Assisted Laser Desorption/Ionization Mass Spectrometry of Enzymatically Synthesized RNA up to 150 kDa," Nucleic Acids Research, 1994, vol. 22 (19), pp. 3866-3870.

Kitagawa Y., et al., "Rapid Diagnosis of Methicillin-Resistant *Staphylococcus Aureus* Bacteremia by Nested Polymerase Chain Reaction," Annals of Surgery, 1996, vol. 224 (5), pp. 665-671.

Knoth K., et al., "Highly Degenerate, Inosine-Containing Primers Specifically Amplify Rare cDNA using the Polymerase Chain Reaction," Nucleic Acids Research, 1988, vol. 16 (22), p. 10932.

Kolbert C.P., et al., "Branched-DNA Assay for Detection of the mecA Gene in Oxacillin-Resistant and Oxacillin-Sensitive *Staphylococci*," Journal of Clinical Microbiology, 1998, vol. 36 (9), pp. 2640-2644.

Kowalak J.A., et al., "A Novel Method for the Determination of Post-Transcriptional Modification in RNA by Mass Spectrometry," Nucleic Acids Research, 1993, vol. 21 (19), pp. 4577-4585.

Krafft a.E., et al., "Evaluation of PCR Testing of Ethanol-Fixed Nasal Swab Specimens as an Augmented Surveillance Strategy for Influenza Virus and Adenovirus Identification," Journal of Clincal Microbiology, 2005, vol. 43 (4), pp. 1768-1775.

Kramer L.D., et al., "Dection of Encephalitis Viruses in Mosquitoes (Diptera: Culicidae) and Avian Tissues," Journal of Medical Entomology, 2002, vol. 39 (2), pp. 312-323.

Kramer L.D., et al., "Dection of St. Louis Encephalitis and Western Equine Encephalomyelitis RNAin Mosquitoes Tested Without Maintainance of a Cold Chain," Journal of the American Mosquito Control Association, 2001, vol. 17 (4), pp. 213-215.

Kresken M., et al., "Prevalence of Mupirocin Resistance in Clinical Isolates of *Staphylocccus Aureus* and *Staphylococcus Epidermidis*: Results of the Antimicrobial Resistance Surveillance Study of the Paul-Ehrlich-Society for Chemotherapy, 2001," International Journal of Antimicrobial Agents, 2004, vol. 23 (6), pp. 577-581.

Krishnan P.U., et al., "Detection of Methicillin and Mupirocin Resistance in *Staphylococcus Aureus*isolates Using Conventional and Molecular Methods: A Descriptive Study from a Burns Unit with Highprevalence of MRSA," Journal of Clinical Pathology, 2002, vol. 55 (10), pp. 745-748.

Kroneman A., et al., "Identification and Characterization of a Porcine Torovirus," Journal of Virology, 1998, vol. 72 (5), pp. 3507-3511.

Krossoy B., et al., "The Putative Polymerase Sequence of Infectious Salmon Anemia Virus Suggests a New Genus within the Orthomyxoviridae," Journal of Virology, 1999, vol. 73 (3), pp. 2136-2142.

Ksiaxek T.G., et al., "A Novel Coronavirus Associated with Severe Acute Respiratory Syndrome," The New England Journal of Medicine, 2003, vol. 348 (20), pp. 1953-1966.

Kupke T., et al., "Molecular Characterization of Lantibiotic-Synthesizing Enzyme EpiD Reveals a Function for Bacterial Dfp Proteins in Coenzyme A Biosynthesis," Journal of Biological Chemistry, 2000, vol. 275 (41), pp. 31838-31846.

Kuroda M., et al., "Whole Genome Sequencing of Meticillin-Resistant *Staphylococcus Aureus*," The Lancet, 2001, vol. 357 (9264), pp. 1225-1240.

Kwok S., et al., "Avoiding False Positives with PCR," Nature, 1989, vol. 339 (6221), pp. 237-238.

Labandeira-Rey, M. et al., "*Staphylococcus Aureus* Panton Valentine Leukocidin CausesNecrotizing Pneumonia," ScienceExpress, 2007, 8 pages.

Lacroix L., et al., "Triplex Formation by Oligonucleotides Containing 5-(1-Propynyl)-2-deoxyuridine: Decreased Magnesium Dependence and Improved Intracellular Gene Targeting," Biochemistry, 1999, vol. 38 (6), pp. 1893-1901.

Laken S.J., et al., "Genotyping by Mass Spectrometric Analysis of Short DNA Fragments," Nature Biotechnology, 1998, vol. 16 (13), pp. 1352-1356.

Lamb R.A., et al., "Sequence of Interrupted and Uninterrupted mRNAs and Cloned DNA Coding for the Two Overlapping Nonstructural Proteins of Influenza Virus," Cell, 1980, vol. 21 (2), pp. 475-485.

Lambert A.J., et al., "Detection of North American Eastern and Western Equine EncephalitisViruses by Nucleic Acid Amplification Assays," Journal of Clinical Microbiology, 2003, vol. 41 (1), pp. 379-385.

Lau L.T., et al., "Nucleic Acid Sequence-Based Amplification Methods to Detect Avian Influenza Virus," Biochemical and Biophysical Research Communications, 2004, vol. 313 (2), pp. 336-342.

Le Cann P., et al., "Quantification of Human Astroviruses in Sewage Using Real-Time RT-PCR," Research in Microbiology, 2004, vol. 155 (1), pp. 11-15.

Lebedev Y., et al., "Oligonucleotides Containing 2-Aminoadenine and 5-Methycytosine are More Effective as Primers for PCR Amplification than their Nonmodified Counterparts," Genetic Analysis: Biomolecular Engineering, 1996, vol. 13 (1), pp. 15-21.

Lednicky J.A., et al., "Polyomaviruses and Human Tumors: A Brief Review of Current Concenpts and Interpretations," Frontiers Bioscience, 1999, vol. 4, pp. D153-164.

Lee J.A., et al., "Rapid Identification of Human Adenovirus Types 3 and 7 from Respiratory Specimens via Multiplex Type-Specific PCR," Journal of Clinical Microbiology, 2005, vol. 43 (11), pp. 5509-5514.

Lee J.H., et al., "Simultaneous Detection of Three Mosquito-Borne Encephalitis Viruses (Eastern equine, La Crosse, and St. Louis) with a Single-Tube Multiplex Reverse Transcriptase Polymerase Chaine Reaction Assay," Journal of the American Mosquito Control Association, 2002, vol. 18 (1), pp. 26-31.

Leif H., et al., "Isolation and Characterization of the Proton-Translocating NADH: Ubiqu None Oxidoreductase from *Escherichia Coli*," European Journal of Biochemistry, 1995, vol. 230 (2), pp. 538-548.

Lengyel A., et al., "Characterization of the Main Protein Components of Adenovirus Virion and itsPossible Use in Laboratory Diagnostics," Acta Microbiologica Immunologica Hungarica, 1998, vol. 43 (3-4), pp. 281-283.

Leroy E.M., et al., "Diagnosis of Ebola Haemorrhagic Fever by RT-PCR in an Epidemic Setting," Journal of Medicinal Virology, 2000, vol. 60 (4), pp. 463-467.

Levi K., et al., "Evaluation of an Isothermal Signal Amplification Method for Rapid Detection of Methicillin-Resistant *Staphylococcus Aureus* from Patient-Screening Swabs," Journal of Clinical Microbiology, 2003, vol. 41 (7), pp. 3187-3191.

Levine S.M., et al., "PCR-Based Detection of Bacillus Anthracis in Formalin-Fixed Tissue from a Patient Receiving Ciprofloxacin," Journal of Clinical Microbiology, 2002, vol. 40 (11), pp. 4360-4362.

Levison P.R., et al., "Recent Developments of Magnetic Beads for Use in Nucleic Acid Purification," Journal of Chromatography, 1998, vol. A816, pp. 107-111.

Lewers K.S., et al., "Detection of Linked QTL for Soybean Brown Stem Rot Resistance in "BSR 101" as Expressed in a Growth Chamber Environment," Molecular Breeding, 1999, vol. 5, pp. 33-42.

Li C., et al., "Evolution of H9N2 Influenza Viruses from Domestic Poultry in Mainland China," Virology, 2005, vol. 340 (1), pp. 70-83.

Li Q., et al., "Genetic Variability of Hexon Loops 1 and 2 between Seven Genome Types of Adenovirus Serotype 7," Archives of Virology, 1999, vol. 144 (9), pp. 1739-1749.

Li Q., et al., "Screening of the High Yield Influenza B Virus on MDCK c14d Cloning of its Whole Genome," International Congress Series, 2004, vol. 1263, pp. 610-614.

Li Q.G., et al., "Analysis of 15 Different Genome Types of Adenovirus Type 7 Isolated on FiveContinents," Journal of Virology, 1986, vol. 60 (1), pp. 331-335.

Li Q.G., et al., "Comparison of 17 Genome Types of Adenovirus Type 3 Identified among Strains Recovered from Six Continents," Journal of Clinical Microbiology, 1988, vol. 26 (5), pp. 1009-1015.

Liebermann H., et al., "Mapping of Epitopes on the Fiber Knobs of Human Adenovirus Serotypes 8 and 15," Intervirology, 2002, vol. 45 (1), pp. 59-66.

Liebermann H., et al., "Mapping of Linear Epitopes on Fibre Knob of Human Adenovirus Serotype 5," Virus Research, 2001, vol. 73 (2), pp. 145-151.

Lim L.P., et al., "The MicroRNAs of Caenorhabditis Elegans," Genes and Development, 2003, vol. 17 (8), pp. 991-1008.

Limbach P.A., et al., "Enzymatic Sequencing of Oligonucleotides with Electrospray Mass Spectrometry," 42nd ASMS Conference on Mass Spectrometry, 1994.

Limoncu M.N., et al., "Emergence of Phenotypic Resistance to Ciprofloxacin and Levofloxacin Inmethicillin-Resistant and Methicillin-Sensitive Staphylococcus Aureus Strains," International Journal of Antimicrobial Agents, 2003, vol. 21 (5), pp. 420-424.

Lin B., et al., "Use of Oligonucleotide Microarrays for Rapid Detection and Serotyping of Acute Respiratory Disease-Associated Adenoviruses," Journal of Clinical Microbiology, 2004, vol. 42 (7), pp. 3232-3239.

Lin P.H., et al., "Oxidative Damage to Mitochondrial DNA in Atrial Muscle of Patients with Atrial Fibrillation," Free Radical Biology and Medicine, 2003, vol. 35 (10), pp. 1310-1318.

Lina G., et al., "Bacterial Competition for Human Nasal Cavity Colonization: Role of Staphylococcalagr Alleles," Applied and Environmental Microbiology, 2003, vol. 69 (1), pp. 18-23.

Lina G., et al., "Involvement of Panton-Valentine Leukocidin-Producing Staphylococcus Aureus in Primary Skin Infections and Pneumonia," Clinical Infectious Diseases, 1999, vol. 29 (5), pp. 1128-1132.

Linssen B., et al., "Development of Reverse Transcription-PCR Assays Specific for Detection of Equine Encephalitis Viruses," Journal of Clinical Microbiology, 2000, vol. 38 (4), pp. 1527-1535.

Little D.P., et al., "MALDI on a Chip: Analysis of Arrays of Low-Femtomole to Subfemtomole Quantities of Synthetic Oligonucleotides and DNA Diagnostic Products Dispensed by a Piezoelectric Pipet," Analytical Chemistry, 1997, vol. 69, pp. 4540-4546.

Liu J.H., et al., "Interregional Transmission of the Internal Protein Genes of H2 Influenza Virus in Migratory Ducks from North America to Eurasia," Virus Genes, 2004, vol. 29 (1), pp. 81-86.

Liu Y., et al., "An Unusual Gene Arrangement for the Putative Chromosome Replication Origin and Circadianexpression of dnaN in Synechococcus sp. Strain PCC 7942," Gene, 1996, vol. 172 (1), pp. 105-109.

Livermore D.M., "The Threat from the Pink Corner," Annals of Medicine, 2003, vol. 35 (4), pp. 226-234.

Loo J.A., et al., "Applying Charge Discrimination with Electrospray Ionization-Mass Spectrometry to Protein Analysis," Journal of American Society for Mass Spectrometry, 1995, vol. 6, pp. 1098-1104.

Lott T.J., et al., "Nucleotide Sequence Analysis of the 5-8s rDNA and Adjacent ITS2 Region of Candidaalbicans and Related Species," Yeast, 1993, vol. 9, pp. 1199-1206.

Louie L., et al., "Evaluation of Three Rapid Methods for Detection of Methicillin Resistance in Staphylococcus Aureus," Journal of Clinical Microbiology, 2000, vol. 38 (6), pp. 2170-2173.

Love B.C., et al., "Cloning and Sequence of the GroESL Heat-Shock Operon of Pasteurella Multocida," Gene, 1995, vol. 166 (1), pp. 179-180.

Lovseth A., et al., "Modified Multiplex PCR Method for Detection of Pyrogenic Exotoxin Genes in Staphylococcal Isolates," Journal of Clinical Microbiology, 2004, vol. 42 (8), pp. 3869-3872.

Lowe T., et al., "A Computer Program for Selection of Oligonucleotide Primers for Polymerase Chain Reactions," Nucleic Acids Research, 1990, vol. 18 (7), pp. 1757-1761.

Lu X., et al., "Molecular Typing of Human Adenoviruses by PCR and Sequencing of a Partial Region of the Hexon Gene," Archives of Virology, 2006, vol. 151 (8), pp. 1587-1602.

Lubman D.M., Application for Continuation Grant by David Mitchell Lubman dated Jun. 4, 1996 and Jun. 14, 1996.

Lubman D.M., Application for Continuation Grant by David Mitchell Lubman dated Jun. 10, 1994 and Jun. 24, 1994.

Lubman D.M., Application for Grant by David Mitchell Lubman dated Sep. 1, 1994 and Sep. 27, 1994.

Lubman D.M., Application for Grant by David Mitchell Lubman dated Oct. 25, 1992 and Oct. 29, 1992.

Ludwig S.L., et al., "Prevalence of Antibodies to Adenovirus Serotypes 4 and 7 among Unimmunized US Army Trainees: Results of a Retrospective Nationwide Seroprevalence Survey," The Journal of Infectious Diseases, 1998, vol. 178 (6), pp. 1776-1778.

Ludwig W., et al., "Bacterial Phylogeny Based on 16S and 23S rRNA Sequence Analysis," FEMS Microbiolofy Reviews, 1994, vol. 15 (2-3), pp. 155-173.

Lukashov V.V., et al., "Evolutionary Relationships among Parvoviruses: Virus-Host Coevolution among Autonomous Primate Parvoviruses and Links between Adeno-Associated and Avian Parvoviruses," Journal of Virology, 2001, vol. 75 (6), pp. 2729-2740.

Ma X.X., et al., "Novel Type of Staphylococcal Cassette Chromosome Mec Identified in Community-Acquired Methicillin-Resistant Staphylococcus Aureus Strains," Antimicrobial Agents and Chemotherapy, 2002, vol. 46 (4), pp. 1147-1152.

Magnuson V.L., et al., "Substrate Nucleotide-Determined Non-Templated Addition of Adenine by Tag DNA Polymerase: Implications for PCR-Based Genotyping and Cloning," BioTechniques, 1996, vol. 21 (4), pp. 700-709.

Malasig M.D., et al., "Simplified Microneutralization Test for Serotyping Adenovirus Isolates," Journal of Clinical Microbiology, 2001, vol. 39 (8), pp. 2984-2986.

Manian F.A., "Asymptomatic Nasal Carriage of Mupirocin-Resistant, Methicillin-Resistant Staphylococcus Aureus (MRSA) in a Pet Dog Associated with MRSA Infection in Household Contacts," Clinical Infectious Diseases, 2003, vol. 36 (2), pp. e26-e28.

Marin J., et al., "Persistence of Viruses in Upper Respiratory Tract of Children with Asthma," Journal of Infection, 2000, vol. 41 (1), pp. 69-72.

Marks F., et al., "Genotyping of Plasmodium Falciparum Pyrimethamine Resistance by Matrix-Assisted Laser Desorption-Ionization Time-of-Flight Mass Spectrometry," Antimicrobial Agents and Chemotherapy, 2004, vol. 48 (2), pp. 466-472.

Marmur J., et al., "Strand Separation and Specific Recombination in Deoxyribonucleic Acids: Biological Studies," Proceedings of the National Academy of Sciences, 1960, vol. 46 (4), pp. 453-461.

Martemyanov K.A., et al., "Extremely Thermostable Elongation Factor (3 from Aquifer aeolicus: Cloning, Expression, Purification, and Characterization in a Heterologous Translation System," Protein Expression and Purification, 2000, vol. 18 (3), pp. 257-261.

Martineau F., et al., "Development of a PCR Assay for Identification of Staphylococci at Genus and Species Levels," Journal of Clinical Microbiology, 2001, vol. 39 (7), pp. 2541- 2547.

Martineau F., et al., "Species-Specific and Ubiquitous-DNA-Based Assays for Rapid Identification of Staphylococcus Aureus," Journal of Clinical Microbiology, 1998, vol. 36 (3), pp. 618-623.

Martin-Lopez J.V., et al., "Simultaneous PCR Detection of Ica Cluster and Methicillin and Mupirocinresistance Genes in Catheter-Isolated *Staphylococcus*," International Microbiology, 2004, vol. 7 (1), pp. 63-66.

Mason V.P., et al., "Diversity and linkage of Replication and Mobilisation Genes in Bacillus Rolling Irclereplicating Plasmids from Diverse Geographical Origins," FEMS Microbiology Ecology, 2002, vol. 42 (2), pp. 235-241.

Matsuoka M., et al., "Characteristic Expression of Three Genes, msr(a), mph(C) and erm(Y), Thatconfer Resistance to Macrolide Antibiotics on *Staphylococcus Aureus*," FEMS Microbiology Letters, 2003, vol. 220 (2), pp. 287-293.

May A.C., "Percent Sequence Identity: The Need to be Explicit," Structure, 2004, vol. 12 (5), pp. 737-738.

Mayerat C., et al., "Comparison of a Competitive Combined Reverse Transcription-PCR Assay with a Branched-DNA Assay for Hepatitis C Virus RNA Quantitation," Journal of Clinical Microbiology, 1996, vol. 34 (11), pp. 2702-2706.

McLafferty F.W., et al., "Comparison of Algorithms and Databases for Matching Unknown Mass Spectra," Journal of the American Society for Mass Spectrometry, 1998, vol. 9 (1), pp. 92-95.

McLuckey S.A., et al., "Ion Trap Tandem Mass Spectrometry Applied to Small Multiply Charged Oligonucleotides with a Modified Base," Journal of the American Society for Mass Spectrometry, 1994, vol. 5, pp. 740-747.

Mehrotra M., et al., "Multiplex PCR for Detection of Genes for Staphylococcus Aureus Enterotoxins, Exfoliative Toxins, Toxic Shock Syndrome Toxin 1, and Methicillin Resistance," Journal of Clinical Microbiology, 2000, vol. 38 (3), pp. 1032-1035.

Mellor J., et al., "Genotype Dependence of Hepatitis C Virus Load Measurement in Commercially Available Quantitative Assays," Journal of Clinical Microbiology, 1999, vol. 37 (8), pp. 2525-2532.

Merlino J., et al., "New Chromogenic Identification and Detection of *Staphylococcus Aureus* and Methicillin-Resistant S. Aureus," Journal of Clinical Microbiology, 2000, vol. 38 (6), pp. 2378-2380.

Merlino J., et al., "Rapid Detection of Non-Multidrug-Resistant and Multidrug-Resistant Methicillin- Resistant *Staphylococcus Aureus* Using Cycling Probe Technology for the mecA Gene," European Journal of Clinical Microbiology and Infectious Diseases, 2003, vol. 22 (5), pp. 322-323.

Metzgar D., et al., "PCR Analysis of Egyptian Respiratory Adenovirus Isolates, Including Identification of Species, Serotypes and Coinfections," Journal of Clinical Microbiology, 2005, vol. 43 (11), pp. 5743-5752.

Miller K.W., et al., "A Compendium of Human Mitochondria! DNA Control Region: Development of an International Standard Forensic Database," Croatian Medical Journal, 2001, vol. 42 (3), pp. 315-327.

Miragaia M., et al., "Genetic Diversity among Methicillin-Resistant *Staphylococcus Epidemidis*(MRSE)," Microbial Drug Resistance, 2005, vol. 11 (2), pp. 83-93.

Miura-Ochiai R., et al., "Quantitative Detection and Rapid Identification of Human Adenoviruses," Journal of Clinical Microbiology, 2007, vol. 45 (3), pp. 958-967.

Mollet C., et al., "RpoB Sequence Analysis as a Novel Basis for Bacterial Identification," Molecular Microbiology, 1997, vol. 26 (5), pp. 1005-1011.

Monroy a.M., et al., "Exvaluation of Reverse Transcriptase Polymerase Chain Reaction for the Detection of Eastern Equine Encephalumyelitis Virus during Vector Surveillance," Journal of Medical Entomology, 1996, vol. 33 (3), pp. 449-457.

Moore C., et al., "Development and Evaluation of a Real-Time Nucleic Acid Sequence Based Amplification Assay for Rapid Detection of Influenza A," Journal of Medical Virology, 2004, vol. 74 (4), pp. 619-628.

Morinaga N., et al., "Purification, Cloning and Charactarizarion of Variant LukE-LukD with Strong Leukocidal Activity of *Staphylococcal* Bi-Component Leukotoxin Family," Microbiology and Immunology, 2003, vol. 47 (1), pp. 81-90.

Morse R., et al., "Nucleotide Sequence of Part of the ropC Gene Encoding the B Subunit of DNA Dependent RNA Polymerase from some Gram-Positive Bacteria and Comparative Amino Acid Sequence Analysis," Systematic and Applied Microbiology, 1996, vol. 19, pp. 150-157.

Murakami K., et al., "Identification of Methicillin-Resistant Strains of *Staphylococci* by Polymerase Chain Reaction," Journal of Clinical Microbiology, 1991, vol. 29 (10), pp. 2240-2244.

Na B.K., et al., "Detection and Typing of Respiratory Adenoviruses in a Single-Tube Multiplex Polymerase Chain Reaction," Journal of Medical Virology, 2002, vol. 66 (4), pp. 512-517.

Nagy M., et al., "Sequence Analysis of Porcine Adenovirus Serotype 5 Fibre Gene: Evidence for Recombination," Virus Genes, 2002, vol. 24 (2), pp. 181-185.

Naito Y., et al., "Molecular Mass Measurement of Polymerase Chain Reaction Products Amplified from Human Blood DNA by Electrospray Ionization Mass Spectrometry," Rapid Communications in Mass Spectrometry, 1995, vol. 9 (15), pp. 1484-1486.

Nakagawa S., et al., "Gene Sequences and Specific Detection for Panton-Valentine Leukocidin," Biochemical and Biophysical Research Communications, 2005, vol. 328 (4), pp. 995-1002.

Nakao H., et al., "Development of a Direct PCR Assay for Detection of the Diphtheria Toxin Gene," Journal of Clinical Microbiology, 1997, vol. 35 (7), pp. 1651-1655.

Narita S., et al., "Phage Conversion of Panton-Valentine Leukocidin in *Staphylococcus Aureus*: Molecular Analysis of a PVL-Converting Phage, cpSLT," Gene, 2001, vol. 268 (1- 2), pp. 195-206.

Naumov G.I., et al., "Discrimination Between the Soil Yeast Species Williopsis Saturnus and Williopsis Suaveolens by the Polymerase Chain Reaction with the Universal Primer N21," Microbiology, 2000, vol. 69 (2), pp. 229-233.

NEB Catalog, 1998/1999, pp. 1, 79, 121 and 284.

Neumann G., et al., "Host Range Restriction and Pathogenicity in the Context of Influenza Pandemic," Emerging Infectious Diseases, 2006, vol. 12 (6), pp. 881-886.

Newcombe J., et al., "PCR of Peripheral Blood for Diagnosis of Meningococcal Disease," Journal of Clinical Microbiology, 1996, vol. 34 (7), pp. 1637-1640.

Ni J., et al., "Interpretation of Oligonucleotide Mass Spectra for Determinationof Sequence Using Electrospray Ionization and Tandem Mass Spectrometry," Analytical Chemistry, 1996, vol. 68 (13), pp. 1989-1999.

Nilsson M., et al., "Evaluation of Mitochondrial DNA Coding Region Assays for Increased Discrimination in Forensic Analysis," Forensic Science International: Genetics, 2008, vol. 2 (1), pp. 1-8.

Nishikawa T., et al., "Reconstitution of Active Recombinant Ship Toxin (Stc)1 from Recombinant Stxl -A and Sbtl -B Subunits Independently Produced by *E. Coli* Clones," FEMS Microbiol Letters, 1999, vol. 178 (1), pp. 13-18.

Non-Final Office Action mailed Feb. 2, 2007 for U.S. Appl. No. 10/844,938, filed May 12, 2004.

Non-Final Office Action mailed Oct. 2, 2009 for U.S. Appl. No. 11/929,707, filed Oct. 30, 2007.

Non-Final Office Action mailed Aug. 4, 2010 for U.S. Appl. No. 12/049,949, filed Mar. 17, 2008.

Non-Final Office Action mailed Apr. 6, 2009 for U.S. App. No. 11/331,987 filed Jan. 13, 2006.

Non-Final Office Action mailed Apr. 7, 2006 for U.S. Appl. No. 10/964,571, filed Oct. 12, 2004.

Non-Final Office Action mailed Aug. 7, 2007 for U.S. Appl. No. 10/844,938, filed May 12, 2004.

Non-Final Office Action mailed Jun. 10, 2009 for U.S. Appl. No. 10/844,938, filed May 12, 2004.

Non-Final Office Action mailed Jan. 12, 2010 for U.S. Appl. No. 11/491,376, filed Jul. 21, 2006.

Non-Final Office Action mailed Oct. 13, 2010 for U.S. Appl. No. 10/754,415 filed Jan. 9, 2004.

Non-Final Office Action mailed Sep. 16, 2009 for U.S. Appl. No. 11/233,630, filed Sep. 21, 2005.

Non-Final Office Action mailed Apr. 17, 2009 for U.S. Appl. No. 12/211,641, filed Sep. 16, 2008.

Non-Final Office Action mailed Nov. 19, 2003 for U.S. Appl. No. 09/798,007, filed Mar. 2, 2001.

Non-Final Office Action mailed Aug. 20, 2007 for U.S. Appl. No. 11/582,863, filed Oct. 17, 2006.

Non-Final Office Action mailed May 20, 2008 for U.S. Appl. No. 10/844,938, filed May 12, 2004.

Non-Final Office Action mailed Oct. 20, 2004 for U.S. Appl. No. 09/891,793, filed Jun. 26, 2001.
Non-Final Office Action mailed Feb. 23, 2009 for U.S. Appl. No. 10/660,122, filed Sep. 11, 2003.
Non-Final Office Action mailed May 26, 2010 for U.S. Appl. No. 11/869,449, filed Oct. 9, 2007.
Non-Final Office Action mailed Jul. 27, 2006 for U.S. Appl. No. 11/209,439, filed Aug. 8, 2005.
Non-Final Office Action mailed Jun. 28, 2010 for U.S. Appl. No. 11/930,002, filed Oct. 30, 2007.
Non-Final Office Action mailed Sep. 28, 2009 for U.S. Appl. No. 11/930,017, filed Oct. 30, 2007.
Non-Final Office Action mailed Dec. 29, 2010 for U.S. Appl. No. 12/616,422, filed Nov. 11, 2009.
Non-Final Office Action mailed Apr. 30, 2010 for U.S. Appl. No. 11/930,108, filed Oct. 31, 2007.
Norder H., et al., "Typing of Hepatitis B Virus Genomes by a Simplified Polymerase Chain Reaction," Journal of Medical Virology, 1990, vol. 31 (3), pp. 215-221.
Nordhoff E., et al., "Matrix Assisted Laser Desorption/Ionization Mass Spectrometry of Nucleic Acids with Wavelengths in the Ultraviolet and Infrared," Rapid Communications in Mass Spectrometry, 1992, vol. 6 (12), pp. 771-776.
Notice of Allowance mailed Apr. 1, 2011 for U.S. Appl. No. 11/233,630, filed Sep. 21, 2005.
Notice of Allowance mailed Jun. 3, 2009 for U.S. Appl. No. 11/331,978, filed Jan. 13, 2006.
Notice of Allowance mailed Aug. 5, 2010 for U.S. Appl. No. 11/233,630, filed Sep. 21, 2005.
Notice of Allowance mailed Aug. 6, 2009 for U.S. Appl. No. 10/728,486, filed Dec. 5, 2003.
Notice of Allowance mailed Dec. 10, 2010 for U.S. Appl. No. 11/233,630, filed Sep. 21, 2005.
Notice of Allowance mailed Dec. 10, 2010 for U.S. Appl. No. 11/491,376, filed Jul. 21, 2006.
Notice of Allowance mailed Nov. 12, 2009 for U.S. Appl. No. 10/728,486, filed Dec. 5, 2003.
Notice of Allowance mailed Dec. 15, 2008 for U.S. Appl. No. 11/331,978, filed Jan. 13, 2006.
Notice of Allowance mailed Sep. 18, 2009 for U.S. Appl. No. 10/660,998, filed Sep. 12, 2003.
Notice of Allowance mailed Nov. 24, 2009 for U.S. Appl. No. 11/331,978, filed Jan. 13, 2006.
Notice of Allowance mailed May 25, 2011 for U.S. Appl. No. 11/929,707, filed Oct. 30, 2007.
Notice of Allowance mailed Oct. 29, 2009 for U.S. Appl. No. 10/660,122, filed Sep. 11, 2003.
Nubel U., et al., "PCR Primers to Amplify 16S rRNA Genes from Cyanobacteria," Applied and Environmental Microbiology, 1997, vol. 63 (8), pp. 3327-3332.
Null Allison P., et al., "Enzymatic Strategies for the Characterization of Nucleic Acids by Electrospray Ionization Mass Spectrometry," Rapid Communications in Mass Spectrometry, 2003, vol. 17 (24), pp. 2699-2706.
Nunes E.L., et al., "Detection of IleS-2 Gene Encoding Mupirocin Resistance in Methicillin-Resistant *Staphylococcus Aureus* by Multiplex PCR," Diagnostic Microbiology and Infectious Disease, 1999, vol. 34 (2), pp. 77-81.
Nygren M., et al., "Quantification of HIV-1 Using Multiple Quantitative Polymerase Chain Reaction Standards and Bioluminometric Detection," Analytical Biochemistry, 2001, vol. 288 (1), pp. 28-38.
Oberacher H., et al., "Increased Foresnic Efficiency of DNA Fingerprints Through Simultaneous Resolution of Length and Nucleotide Variability by High-Performance Mass Spectrometry," Human Mutation, 2008, vol. 29 (3), pp. 427-432.
Office Action mailed Apr. 1, 2004 for U.S. Appl. No. 10/156,608, filed May 24, 2002.
Office Action mailed May 1, 2006 for U.S. Appl. No. 10/660,998, filed Sep. 12, 2003.
Office Action mailed Feb. 2, 2011 for U.S. Appl. No. 11/869,449, filed Oct. 9, 2007.
Office Action mailed Jan. 2, 2009 for U.S. Appl. No. 11/060,135, filed Feb. 17, 2005.
Office Action mailed Jun. 2, 2006 for U.S. Appl. No. 10/933,928, filed Sep. 3, 2004.
Office Action mailed Jun. 2, 2008 for U.S. Appl. No. 11/331,978, filed Jan. 13, 2006.
Office Action mailed Oct. 2, 2008 for U.S. Appl. No. 11/233,630, filed Sep. 21, 2005.
Office Action mailed Oct. 2, 2009 for Japanese Application No. 2005508560 filed Dec. 5, 2003.
Office Action mailed Aug. 3, 2006 for U.S. Appl. No. 10/660,998, filed Sep. 12, 2003.
Office Action mailed Aug. 3, 2009 for U.S. Appl. No. 11/754,174, filed May 25, 2007.
Office Action mailed Dec. 3, 2003 for U.S. Appl. No. 10/325,527, filed Dec. 18, 2002.
Office Action mailed Feb. 3, 2011 for U.S. Appl. No. 12/326,800, filed Dec. 2, 2008.
Office Action mailed Nov. 3, 2008 for U.S. Appl. No. 10/728,486, filed Dec. 5, 2003.
Office Action mailed Dec. 4, 2006 for Indian Application No. 1136KOLNP2003 filed Mar. 4, 2002.
Office Action mailed Feb. 4, 2009 for U.S. Appl. No. 11/404,561 filed Apr. 12, 2006.
Office Action mailed Jun. 4, 2009 for U.S. Appl. No. 10/754,415 filed Jan. 9, 2004.
Office Action mailed May 4, 2010 for U.S. Appl. No. 90/010,447, filed Apr. 9, 2009.
Office Action mailed May 4, 2010 for U.S. Appl. No. 90/010,448, filed Apr. 9, 2009.
Office Action mailed Nov. 4, 2009 for European Application No. 02709785.6 filed Mar. 4, 2002.
Office Action mailed Sep. 4, 2008 for Australian Application No. 2003297687 filed Dec. 5, 2003.
Office Action mailed Aug. 5, 2010 for European Application No. 02709785.6 filed Mar. 4, 2002.
Office Action mailed Sep. 5, 2006 for U.S. Appl. No. 10/660,996, filed Sep. 12, 2003.
Office Action mailed Jan. 6, 2011 for Israel Application No. 157661 filed Mar. 4, 2002.
Office Action mailed Jul. 6, 2006 for U.S. Appl. No. 10/660,122, filed Sep. 11, 2003.
Office Action mailed Mar. 6, 2009 for U.S. Appl. No. 11/233,630, filed Sep. 21, 2005.
Office Action mailed Nov. 6, 2002 for U.S. Appl. No. 09/798,007, filed Mar. 2, 2001.
Office Action mailed Apr. 7, 2009 for Canadian Application No. 2525498 filed May 13, 2004.
Office Action mailed Apr. 7, 2009 for European Application No. 07760292.8 filed Apr. 6, 2007.
Office Action mailed Apr. 7, 2009 for U.S. Appl. No. 10/660,998, filed Sep. 12, 2003.
Office Action mailed Aug. 7, 2007 for U.S. Appl. No. 10/660,998, filed Sep. 12, 2003.
Office Action mailed Feb. 7, 2008 for European Application No. 03796752.8 filed Dec. 5, 2003.
Office Action mailed Jun. 7, 2010 for European Application No. 06800205.4 filed Jul. 27, 2006.
Office Action mailed Jan. 8, 2003 for U.S. Appl. No. 09/798,007, filed Mar. 2, 2001.
Office Action mailed Jan. 8, 2007 for U.S. Appl. No. 09/891,793, filed Jun. 26, 2001.
Office Action mailed Mar. 8, 2005 for U.S. Appl. No. 09/891,793, filed Jun. 26, 2001.
Office Action mailed Mar. 8, 2007 for U.S. Appl. No. 11/060,135, filed Feb. 17, 2005.
Office Action mailed Sep. 8, 2006 for Chinese Application No. 02809122.1 filed Mar. 4, 2002.
Office Action mailed Dec. 9, 2004 for U.S. Appl. No. 10/156,608, filed May 24, 2002.
Office Action mailed Dec. 9, 2009 for U.S. Appl. No. 90/010,210, filed Jun. 27, 2008.
Office Action mailed Dec. 9, 2009 for U.S. Appl. No. 90/010,447, filed Apr. 9, 2009.

Office Action mailed Dec. 9, 2009 for U.S. Appl. No. 90/010,448, filed Apr. 9, 2009.
Office Action mailed Feb. 9, 2007 for Chinese Application No. 02809122.1 filed Mar. 4, 2002.
Office Action mailed Jan. 9, 2008 for Japanese Application No. 2002570692 filed Mar. 4, 2002.
Office Action mailed Jul. 9, 2008 for U.S. Appl. No. 10/660,122, filed Sep. 11, 2003.
Office Action mailed Jul. 9, 2008 for U.S. Appl. No. 11/331,987, filed Jan. 13, 2006.
Office Action mailed Mar. 9, 2004 for U.S. Appl. No. 09/891,793, filed Jun. 26, 2001.
Office Action mailed Nov. 9, 2010 for U.S. Appl. No. 11/331,987, filed Jan. 13, 2006.
Office Action mailed Dec. 10, 2009 for U.S. Appl. No. 11/929,910, filed Oct. 30, 2007.
Office Action mailed Feb. 10, 2005 for U.S. Appl. No. 09/798,007, filed Mar. 2, 2001.
Office Action mailed Feb. 10, 2006 for Australian Application No. 2002244250 filed Mar. 4, 2002.
Office Action mailed Jun. 10, 2009 for U.S. Appl. No. 90/010,210, filed Jun. 27, 2008.
Office Action mailed Jun. 10, 2010 for U.S. Appl. No. 90/010,447, filed Apr. 9, 2009.
Office Action mailed Jun. 10, 2010 for U.S. Appl. No. 90/010,448, filed Apr. 9, 2009.
Office Action mailed Oct. 10, 2007 for U.S. Appl. No. 10/754,415, filed Jan. 9, 2004.
Office Action mailed Sep. 10, 2008 for Australian Application No. 2003302236 filed Dec. 5, 2003.
Office Action mailed Aug. 11, 2005 for U.S. Appl. No. 09/891,793, filed Jun. 26, 2001.
Office Action mailed Aug. 11, 2008 for Singapore Application No. 200600545.8 filed Apr. 23, 2004.
Office Action mailed Aug. 11, 2010 for U.S. Appl. No. 90/010,447, filed Apr. 9, 2009.
Office Action mailed Aug. 11, 2010 for U.S. Appl. No. 90/010,448, filed Apr. 9, 2009.
Office Action mailed Dec. 11, 2007 for U.S. Appl. No. 10/660,998, filed Sep. 12, 2003.
Office Action mailed Jul. 11, 2003 for U.S. Appl. No. 09/798,007, filed Mar. 2, 2001.
Office Action mailed Jun. 11, 2010 for U.S. Appl. No. 90/010,210, filed Jun. 27, 2008.
Office Action mailed Mar. 11, 2005 for U.S. Appl. No. 10/325,527, filed Dec. 18, 2002.
Office Action mailed May 11, 2007 for U.S. Appl. No. 10/728,486, filed Dec. 5, 2003.
Office Action mailed Jul. 12, 2006 for U.S. Appl. No. 09/891,793, filed Jun. 26, 2001.
Office Action mailed Jun. 12, 2008 for U.S. Appl. No. 10/754,415, filed Jan. 12, 2004.
Office Action mailed Jun. 12, 2008 for U.S. Appl. No. 10/754,415, filed Jan. 9, 2004.
Office Action mailed Jun. 12, 2009 for Chinese Application No. 200480016187.9 filed May 13, 2004.
Office Action mailed May 12, 2002 for U.S. Appl. No. 09/798,007, filed Mar. 2, 2001.
Office Action mailed Aug. 13, 2009 for U.S. Appl. No. 11/674,538, filed Feb. 13, 2007.
Office Action mailed Jul. 13, 2004 for U.S Appl. No. 09/891,793, filed Jun. 26, 2001.
Office Action mailed Jul. 13, 2007 for U.S. Appl. No. 11/233,630, filed Sep. 21, 2005.
Office Action mailed Jul. 13, 2010 for U.S. Appl. No. 11/929,930, filed Oct. 30, 2007.
Office Action mailed Mar. 13, 2006 for U.S. Appl. No. 10/754,415, filed Jan. 9, 2004.
Office Action mailed Nov. 13, 2003 for U.S. Appl. No. 09/891,793, filed Jun. 26, 2001.
Office Action mailed Sep. 13, 2006 for U.S. Appl. No. 09/891,793 filed Jun. 26, 2001.
Office Action mailed Jul. 14, 2004 for U.S. Appl. No. 10/326,642, filed Dec. 18, 2002.
Office Action mailed Jun. 14, 2004 for U.S. Appl. No. 09/891,793, filed Jun. 26, 2001.
Office Action mailed Mar. 14, 2011 for U.S. Appl. No. 11/930,002, filed Oct. 30, 2007.
Office Action mailed Aug. 15, 2008 for U.S. Appl. No. 11/331,978, filed Jan. 13, 2006.
Office Action mailed Dec. 15, 2008 for Israel Application No. 157661 filed Mar. 4, 2002.
Office action mailed Dec. 15, 2010 for Canadian Application No. 2508726 filed Dec. 5, 2003.
Office Action mailed Jan. 15, 2008 for Israel Application No. 157661 filed Mar. 4, 2002.
Office Action mailed Jul. 15, 2009 for U.S. Appl. No. 11/060,135, filed Feb. 17, 2005.
Office Action mailed Mar. 15, 2010 for European Application No. 08730682.5 filed Feb. 25, 2008.
Office Action mailed Nov. 15, 2007 for U.S. Appl. No. 11/331,978, filed Jan. 13, 2006.
Office Action mailed Sep. 15, 2005 for U.S. Appl. No. 10/156,608, filed May 24, 2002.
Office Action mailed Apr. 16, 2002 for U.S. Appl. No. 09/798,007, filed Mar. 2, 2001.
Office Action mailed Apr. 16, 2008 for U.S. Appl. No. 11/233,630, filed Sep. 21, 2005.
Office Action mailed Apr. 16, 2009 for U.S. Appl. No. 90/010,210, filed 27 Jun. 2008.
Office Action mailed Aug. 16, 2004 for U.S. Appl. No. 10/325,527, filed Dec. 18, 2002.
Office Action mailed Aug. 16, 2010 for U.S. Appl. No. 11/929,707, filed Oct. 30, 2007.
Office Action mailed Feb. 16, 2011 for U.S. Appl. No. 11/929,910, filed Oct. 30, 2007.
Office Action mailed Jul. 16, 2007 for U.S. Appl. No. 11/331,987, filed Jan. 13, 2006.
Office Action mailed Mar. 16, 2006 for U.S. Appl. No. 09/891,793, filed Jun. 26, 2001.
Office Action mailed Mar. 16, 2010 for Canadian Application No. 2616281 filed Jul. 21, 2006.
Office Action mailed May 16, 2008 for U.S. Appl. No. 11/404,561, filed Apr. 12, 2006.
Office Action mailed Nov. 16, 2009 for Japanese Application No. 2005508488 filed Dec. 5, 2003.
Office Action mailed Jun. 17, 2008 for U.S. Appl. No. 11/582,863, filed Oct. 17, 2006.
Office Action mailed Mar. 17, 2006 for U.S. Appl. No. 10/660,122, filed Sep. 11, 2003.
Office Action mailed Nov. 17, 2006 for U.S. Appl. No. 10/754,415, filed Jan. 9, 2004.
Office Action mailed Oct. 17, 2007 for U.S. Appl. No. 10/728,486, filed Dec. 5, 2003.
Office Action mailed Oct. 17, 2008 for U.S. Appl. No. 11/331,978, filed Jan. 13, 2006.
Office Action mailed Sep. 17, 2008 for European Application No. 03796752.8 filed Dec. 5, 2003.
Office Action mailed Sep. 17, 2008 for U.S. Appl. No. 10/660,122, filed Sep. 11, 2003.
Office Action mailed Feb. 18, 2010 for European Application No. 03814656.9 filed Dec. 5, 2003.
Office Action mailed Jan. 18, 2011 for U.S. Appl. No. 11/930,108, filed Oct. 31, 2007.
Office Action mailed May 18, 2005 for New Zealand Application No. 527857 filed Mar. 4, 2002.
Office Action mailed Sep. 18, 2006 for U.S. Appl. No. 10/660,997, filed Sep. 12, 2003.
Office Action mailed Sep. 18, 2008 for Australian Application No. 2003298030 filed Dec. 5, 2003.
Office Action mailed Sep. 18, 2008 for U.S. Appl. No. 10/660,998, filed Sep. 12, 2003.
Office Action mailed Jan. 19, 2007 for U.S. Appl. No. 11/059,776, filed Feb. 17, 2005.

Office Action mailed May 19, 2005 for U.S. Appl. No. 09/891,793, filed Jun. 26, 2001.
Office Action mailed Nov. 19, 2004 for U.S. Appl. No. 10/156,608, filed May 24, 2002.
Office Action mailed Oct. 19, 2007 for U.S. Appl. No. 11/210,516, filed Aug. 24, 2005.
Office Action mailed Sep. 19, 2006 for U.S. Appl. No. 10/660,122, filed Sep. 11, 2003.
Office Action mailed Sep. 19, 2007 for U.S. Appl. No. 10/660,122, filed Sep. 11, 2003.
Office Action mailed Apr. 20, 2007 for U.S. Appl. No. 10/660,122, filed Sep. 11, 2003.
Office Action mailed Apr. 20, 2009 for U.S. Appl. No. 10/891,337, filed Jul. 14, 2004.
Office Action mailed Dec. 20, 2006 for U.S. Appl. No. 10/728, 486, filed Dec. 5, 2003.
Office Action mailed Jul. 20, 2005 for U.S. Appl. No. 10/156,608, filed May 24, 2002.
Office Action mailed Jun. 20, 2002 for U.S. Appl. No. 09/798,007, filed Mar. 2, 2001.
Office Action mailed Nov. 20, 2003 for U.S. Appl. No. 10/323,438, filed Dec. 18, 2002.
Office Action mailed Nov. 20, 2006 for U.S. Appl. No. 09/891,793, filed Jun. 26, 2001.
Office Action mailed Nov. 20, 2006 for European Application No. 02709785.6 filed Mar. 4, 2002.
Office Action mailed Sep. 20, 2010 for U.S. Appl. No. 90/010,447, filed Apr. 9, 2009.
Office Action mailed Sep. 20, 2010 for U.S. Appl. No. 90/010,448, filed Apr. 9, 2009.
Office Action mailed Apr. 21, 2009 for U.S. Appl. No. 90/010,209, filed Jun. 27, 2008.
Office Action mailed Mar. 21, 2008 for U.S. Appl. No. 10/660,122, filed Sep. 11, 2003.
Office Action mailed May 21, 2008 for U.S. Appl. No. 10/943,344, filed Sep. 17, 2004.
Office Action mailed Nov. 21, 2003 for U.S. Appl. No. 10/326,642, filed Dec. 18, 2002.
Office Action mailed Nov. 21, 2006 for U.S. Appl. No. 10/660,997, filed Sep. 12, 2003.
Office Action mailed Oct. 21, 2005 for U.S. Appl. No. 10/326,641, filed Dec. 18, 2002.
Office Action mailed Oct. 21, 2009 for U.S. Appl. No. 12/326,800, filed Dec. 2, 2008.
Office Action mailed Apr. 22, 2009 for U.S. Appl. No. 11/491,376, filed Jul. 21, 2006.
Office Action mailed Jul. 22, 2008 for U.S. Appl. No. 90/010,209, filed Jun. 27, 2008.
Office Action mailed Jul. 22, 2008 for U.S. Appl. No. 90/010,210, filed Jun. 27, 2008.
Office Action mailed Jul. 22, 2009 for European Application No. 04775904.8 filed Apr. 23, 2004.
Office Action mailed Nov. 22, 2006 for U.S. Appl. No. 10/660,996, filed Sep. 12, 2003.
Office Action mailed Oct. 22, 2007 for Singapore Application No. 200600545.8 filed Apr. 23, 2004.
Office Action mailed Oct. 22, 2007 for U.S. Appl. No. 11/331,987, filed Jan. 13, 2006.
Office Action mailed Sep. 22, 2003 for U.S. Appl. No. 09/798,007, filed Mar. 2, 2001.
Office Action mailed Sep. 22, 2010 for Canadian Application No. 2510007 filed Dec. 5, 2003.
Office Action mailed Apr. 23, 2010 for U.S. Appl. No. 90/010,210, filed Jun. 27, 2008.
Office Action mailed Feb. 23, 2009 for U.S. Appl. No. 10/943,344, filed Sep. 17, 2004.
Office Action mailed Jan. 23, 2008 for U.S. Appl. No. 10/728,486, filed Dec. 5, 2003.
Office Action mailed Jan. 23, 2008 for U.S. Appl. No. 11/059,776, filed Feb. 17, 2005.
Office Action mailed May 23, 2003 for U.S. Appl. No. 09/891,793, filed Jun. 26, 2001.
Office Action mailed May 23, 2005 for U.S. Appl. No. 10/156,608, filed May 24, 2002.
Office Action mailed Oct. 23, 2003 for New Zealand Application No. 527857 filed Mar. 4, 2002.
Office Action mailed Apr. 24, 2009 for U.S. Appl. No. 90/010,447, filed Apr. 9, 2009.
Office Action mailed Apr. 24, 2009 for U.S. Appl. No. 90/010,448, filed Apr. 9, 2009.
Office Action mailed Aug. 24, 2010 for U.S. Appl. No. 90/010,210, filed Jun. 27, 2008.
Office Action mailed Dec. 24, 2004 for New Zealand Application No. 527857 filed Mar. 4, 2002.
Office Action mailed Feb. 24, 2004 for U.S. Appl. No. 10/326,642, filed Dec. 18, 2002.
Office Action mailed Jan. 24, 2005 for U.S. Appl. No. 10/326,642, filed Dec. 18, 2002.
Office Action mailed Jan. 24, 2007 for U.S. Appl. No. 10/660,998, filed Sep. 12, 2003.
Office Action mailed Jul. 24, 2007 for Mexican Application No. PAA2003007927 filed Sep. 2, 2003.
Office Action mailed Jul. 24, 2007 for U.S. Appl. No. 11/060,135, filed Feb. 17, 2005.
Office Action mailed Jul. 24, 2009 for U.S. Appl. No. 11/754,182, filed May 25, 2007.
Office Action mailed Jun. 24, 2008 for European Application No. 06800205.4 filed Jul. 27, 2006.
Office Action mailed Mar. 24, 2011 for U.S. Appl. No. 11/929,930, filed Oct. 30, 2007.
Office Action mailed Nov. 24, 2009 for U.S. Appl. No. 90/010,210, filed Jun. 27, 2008.
Office Action mailed Sep. 24, 2009 for U.S. Appl. No. 90/010,210, filed Jun. 27, 2008.
Office Action mailed Aug. 25, 2009 for U.S. Appl. No. 11/754,169, filed May 25, 2007.
Office Action mailed Jul. 25, 2008 for European Application No. 04775904.8 filed Apr. 23, 2004.
Office Action mailed Jun. 25, 2009 for Singapore Application No. 200600545.8 filed Apr. 23, 2004.
Office Action mailed Jun. 25, 2009 for U.S. Appl. No. 11/869,449, filed Oct. 9, 2007.
Office Action mailed Jun. 25, 2009 for U.S. Appl. No. 90/010,210, filed Jun. 27, 2008.
Office Action mailed Mar. 25, 2008 for U.S. Appl. No. 11/060,135, filed Feb. 17, 2005.
Office Action mailed Aug. 26, 2003 for U.S. Appl. No. 09/891,793, filed Jun. 26, 2001.
Office Action mailed Aug. 26, 2010 for Canadian Application No. 2508584 filed Dec. 5, 2003.
Office Action mailed Jul. 26, 2004 for U.S. Appl. No. 10/323,438, filed Dec. 18, 2002.
Office Action mailed May 26, 2005 for U.S. Appl. No. 10/156,608, filed May 24, 2002.
Office Action mailed May 26, 2006 for U.S. Appl. No. 10/660,997, filed Sep. 12, 2003.
Office Action mailed Feb. 27, 2003 for U.S. Appl. No. 09/798,007, filed Mar. 2, 2001.
Office Action mailed Feb. 27, 2007 for U.S. Appl. No. 10/754,415, filed Jan. 9, 2004.
Office Action mailed Feb. 27, 2007 for U.S. Appl. No. 10/943,344, filed Sep. 17, 2004.
Office Action mailed Jul. 27, 2006 for U.S. Appl. No. 10/728,486, filed Dec. 5, 2003.
Office Action mailed Jul. 27, 2009 for Canadian Application No. 2439655 filed Mar. 4, 2002.
Office Action mailed Apr. 28, 2010 for Singapore Application No. 200600545.8 filed Apr. 23, 2004.
Office Action mailed Aug. 28, 2006 for U.S. Appl. No. 10/754,415, filed Jan. 9, 2004.
Office Action mailed Feb. 28, 2006 for U.S. Appl. No. 10/660,996, filed Sep. 12, 2003.
Office Action mailed Jul. 28, 2009 for U.S. Appl. No. 11/754,163, filed May 25, 2007.

Office Action mailed Jul. 28, 2010 for U.S. Appl. No. 90/010,210, filed Jun. 27, 2008.
Office Action mailed May 28, 2003 for U.S. Appl. No. 09/798,007, filed Mar. 2, 2001.
Office Action mailed Mar. 29, 2010 for Australian Application No. 2006272776 filed Jul. 21, 2006.
Office Action mailed May 29, 2007 for U.S. Appl. No. 11/059,776, filed Feb. 17, 2005.
Office Action mailed Oct. 29, 2009 for U.S. Appl. No. 90/010,447, filed Apr. 9, 2009.
Office Action mailed Oct. 29, 2009 for U.S. App. No. 90/010,448, filed Apr.9, 2009.
Office Action mailed Aug. 30, 2007 for U.S. Appl. No. 10/754,415, filed Jan. 9, 2004.
Office Action mailed Jul. 30, 2008 for Australian Application No. 2004248107 filed Apr. 23, 2004.
Office Action mailed Jul. 30, 2009 for Japanese Application No. 2002570692 filed Mar. 4, 2002.
Office Action mailed Jun. 30, 2004, for U.S. Appl. No. 09/798,007, filed Mar. 2, 2001.
Office Action mailed Jun. 30, 2010 for U.S. Appl. No. 90/010,210, filed Jun. 27, 2008.
Office Action mailed Jun. 30, 2010 for U.S. Appl. No. 90/010,447, filed Apr. 9, 2009.
Office Action mailed Jun. 30, 2010 for U.S. Appl. No. 90/010,448, filed Apr. 9, 2009.
Office Action mailed May 30, 2006 for U.S. Appl. No. 10/660,996, filed Sep. 12, 2003.
Office Action mailed Nov. 30, 2009 for U.S. Appl. No. 10/660,122, filed Sep. 11, 2003.
Office Action mailed Sep. 30, 2005 for Chinese Application No. 02809122.1 filed Mar. 4, 2002.
Office Action mailed Jan. 31, 2003 for U.S. Appl. No. 09/798,007, filed Mar. 2, 2001.
Office Action mailed Jan. 31, 2007 for Philippines Application No. PH12003500824 filed Mar. 4, 2002.
O"Guinn M.L., et al., "Field Detection of Eastern Equine Encephalitis Virus in the Amazon Basin Region of Peru Using Reverse Transcription-Polymerase Chain Reaction Adapted for Field Identification of Arthropod-Borne Pathogens," American Journal of Tropical Medicine and Hygiene, 2004, vol. 70 (2), pp. 164-171.
Oizumi N., et al., "Relationship Between Mutations in the DNA Gyrase and Topoisomerase IV Genes and Nadifloxacin Resistance in Clinically Isolated Quinolone-Resistant *Staphylococcus Aureus*," Journal of Infection and Chemotherapy, 2001, vol. 7 (3), pp. 191-194.
Okada M., et al., "Detection and Sequence-Based Typing of Human Adenoviruses Using Sensitiveuniversal Primer Sets for the Hexon Gene," Archives of Virology, 2007, vol. 152 (1), pp.1-9.
Okuma K., et al., "Dissemination of New Methicillin-Resistant *Staphylococcus aureus* Clones in the Community," Journal of Clinical Microbiology, 2002, vol. 40 (11), pp. 4289- 4294.
Oliveira D.C., et al., "Genetic Organization of the Downstream Region of the mecA Element inMethicillin-Resistant *Staphylococcus aureus* Isolates Carrying Different Polymorphisms of This Region," Antimicrobial Agents and Chemotherapy, 2000, vol. 44 (7), pp. 1906-1910.
Oliveira D.C., et al., "Multiplex PCR Strategy for Rapid Identification of Structural Types and Variants of the mec Element in Methicillin-Resistant *Staphylococcus aureus*," Antimicrobial Agents and Chemotherapy, 2002, vol. 46 (7), pp. 2155-2161.
Olsen B., et al., "Transhemispheric Exchange of Lyme Disease Spyrochetes by Seabirds," Journal of Clinical Microbiology, 1995, vol. 33 (12), pp. 3270-3274.
Osiowy C., et al., "Direct Detection of Respiratory Syncytial Virus, Parainfluenza Virus, and Adenovirus in Clinical Respiratory Specimens by a Multiplex Reverse Transcription-PCR Assay," Journal of Clinical Microbiology, 1998, vol. 36 (11), pp. 3149-3154.
Ostrander E.A., et al., "Identification and Characterization of Dinucleotide Repeat (CA)n. Markers for Genetic Mapping in Dog," Genomics, 1993, vol. 16 (1), pp. 207-213.
Ounissi H., et al., "Gene Homogeneity for Aminoglycoside-Modifying Enzymes in Gram-PositiveCocci," Antimicrobial Agents and Chemotherapy, 1990, vol. 34 (11), pp. 2164- 2168.

Palys T., et al., "Discovery and Classification of Ecological Diversity in the Bacterial World: the Role of DNA Sequence Data," International Journal of Systematic Bacteriology, 1997, vol. 47 (4), pp. 1145-1156.
Pan Z.Q., et al., "Oligonucleotide-Targeted Degradation of U1 and U2 snRNAs Reveals Differential Interactions of Simian Virus 40 pre-mRNAs with snRNPs," Nucleic Acids Research, 1989, vol. 17 (16), pp. 6553-6568.
Pannetier C., et al., "Quantitative Titration of Nucleic Acids by Enzymatic Amplification Reactions Run to Saturation," Nucleic Acids Research, 1993, vol. 21 (3), pp. 577-583.
Parson W., et al., "Population Data for 101 Austrian Caucasian Mitochondrial DNA d-Loop Sequences: Application of mtDNA Sequence Analysis to a Forensic Case," International Journal of Legal Medicine, 1998, vol. 111 (3), pp. 124-132.
Partial European Search Report for Application No. EP01106974, mailed on Dec. 16, 2002, 2 pages.
Pastorino B., et al., "Development of a TaqMan PCR Assay Without RNA Extraction Step for the Detection and Quantification of African Chikungunya Viruses," Journal of Virological Methods, 2005, vol. 124 (1-2), pp. 65-71.
Paterson A.H., et al., "Fine Mapping of Quantitative Trait Loci Using Selected Overlapping Recombinant Chromosomes, in an Interspecies Cross of Tomato," Genetics, 1990, vol. 124 (3), pp. 735-742.
Pawa a., et al., "Co-Transfer of Plasmids in Association with Conjugative Transfer of Mupirocin or Mupirocin and Penicillin Resistance in Methicillin-Resistant *Staphylococcus Aureus*," Journal of Medicinal Microbiology, 2000, vol. 49 (12), pp. 1103-1107.
Payne D., et al., "Antimicrobials: The Challenge of Antibiotic Resistant Bacterial Pathogens: The Medical Need, The Market and Prospects for New Antimicrobial Agents," Current Opinion in Microbiology, 2004, vol. 7, pp. 435-438.
Perez-Roth E., et al., "Multiplex PCR for Simultaneous Identification of *Staphylococcus aureus* and Detection of Methicillin and Mupirocin Resistance," Journal of Clinical Microbiology, 2001, vol. 39 (11), pp. 4037-4041.
Peters S.E., et al., "Quantification of the Detection of Pneumocystis Carinii by DNA Amplification," Molecular and Cellur Probes, 1992, vol. 6 (2), pp. 115-117.
Pfeffer M., et al., "Genus-Specific Detection of Alphaviruses by a Semi-Nested ReverseTranscription-Polymerase Chain Reaction," American Journal of Tropical Medicine and Hygiene, 1997, vol. 57 (6), pp. 709-718.
Pfeffer M., et al., "Specific Detection of Chikungunya Virus Using a RT-PCR/Nested PCR Combination," Journal of Veterinary Medicine B, 2002, vol. 49 (1), pp. 49-54.
Pieles U., et al., "Matrix-Assisted Laser Desorption Ionization Time-of-Flight Spectrometry: APowerful Tool for the Mass and Sequence Analysis of Natural and Modified Oligonucleotides, 787 reexamination," Nucleic Acids Research, 1993, vol. 21 (14), pp. 3191-3196.
Pillai S.D., et al., "Rapid Molecular Detection of Microbial Pathogens: Breakthroughs and Challenges," Archives of Virology, 1997, vol. 13, pp. 67-82.
Piper J., et al., "Commercially Available Technique for Rapid Laboratory Detection of MethicillinResistance Among *Staphylococcus Aureus*," Diagnostic Microbiology and Infectious Disease, 1988, vol. 11 (3), pp. 177-180.
Poddar S.K., et al., "Detection of Adenovirus using PCR and Molecular Beacon," Journal of Virological Methods, 1999, vol. 82 (1), pp. 19-26.
Pring-Akerblom P., et al., "Multiplex Polymerase Chain Reaction for Subgenus-Specific Detection of Human Adenoviruses in Clinical Samples," Journal of Medical Virology, 1999, vol. 58 (1), pp. 87-92.
Pring-Akerblom P., et al., "PCR-Based Detection and Typing of Human Adenoviruses in Clinical Samples," Research in Virology, 1997, vol. 148 (3), pp. 225-231.
PROMEGA. T4 Polynucleotide Kinase, Technical Bulletin No. 519, 2002.
Puthavathana P., et al., "Molecular Characterization of the Complete Genome of Human Influenza H5N1 Virus Isolates from Thailand," Journal of General Virology, 2005, vol. 86 (2), pp. 423-433.

Qadri S.M., et al., "Rapid Detection of Methicillin-Resistant *Staphylococcus Aureus* by CrystalMRSA ID System," Journal of Clinical Microbiology, 1994, vol. 32 (7), pp. 1830-1832.

Raaum R.L., et al., "Catarrhine Primate Divergence Dates Estimated from Complete Mitochondria Genomes: Concordance with Fossil and Nuclear DNA Evidence," Journal of Human Evolution, 2005, vol. 48 (3), pp. 237-257.

Ramisse V., et al., "Identification and Characterization of Bacillus Anthracis by Multiplex PCR Analysis of Sequences on Plasmids pX01 and pX02 and Chromosomal DNA," FEMS Microbiology Letters, 1996, vol. 145 (1), pp. 9-16.

Reischl U., "Application of Molecular Biology-Based Methods to theDiagnosis of Infectious Diseases 1, e72-e77.," Frontiers in Bioscience, 1996, vol. 1 (1), pp. e72-e77.

Reischl U., et al., "Rapid Identification of Methicillin-Resistant *Staphylococcus aureus* and Simultaneous Species Confirmation Using Real-Time Fluorescence PCR," Journal of Clinical Microbiology, 2000, vol. 38 (6), pp. 2429-2433.

Roberts M.M., et al., "Three-Dimensional Structure of the Adenovirus Major Coat Protein Hexon," Science, 1986, vol. 232 (4754), pp. 1148-1151.

Roberts M.S., et al., "Recombination and Migration Rates in Natural Populations of *Bacillus Subtilis* and *Bacillus Mojavensis*," Evolution, 1995, vol. 49 (6), pp. 1081-1094.

Robinson D.A., et al., "Multilocus Sequence Typing and the Evolution of Methicillin-Resistant *Staphylococcus Aureus*," Clinical Microbiology and Infection, 2004, vol. 10, pp. 92-97.

Ross P., et al., "High Level Multiplex Genotyping by MALDI-TOF Mass Spectrometry," Nature Biotechnology, 1998, vol. 16 (13), pp. 1347-1351.

Rota P.A., et al., "Sequencing of a cDNA Clone of the Nucleoprotein Gene of Influenza B/Ann Arbor/1/86," Nucleic Acids Research, 1989, vol. 17 (9), pp. 3595.

Ruest A., et al., "Comparison of the Directigen Flu A+B test, the QuickVue Influenza Test, and Clinical Case Definition to Viral Culture and Reverse Transcription-PCR for Rapid Diagnosis of Influenza Virus Infection," Journal of Clinical Microbiology, 2003, vol. 41 (8), pp. 3487-3493.

Rupf S., et al., "Quantitative Determination of *Streptococcus* Mutans by using Competitive Polymerasechain Reaction," European Journal of Oral Sciences, 1999, vol. 107 (2), pp. 75-81.

Russell K.L., et al., "Transmission Dynamics and Prospective Environmental Sampling of Adenovirus in a Military Recruit Setting," Journal of Infectious Diseases, 2006, vol. 194 (7), pp. 877-885.

Sabat A., et al., "Comparison of PCR-Based Methods for Typing *Staphylococcus Aureus* Isolates," Journal of Clinical Microbiology, 2006, vol. 44 (10), pp. 3804-3807.

Sackesen C., et al., "Use of Polymerase Chain Reaction for Detection of Adenovirus in Children Withor Without Wheezing," Turkish Journal of Pediatrics, 2005, vol. 47 (3), pp. 227-231.

Sakai H., et al., "Simultaneous Detection of *Staphylococcus Aureus* and Coagulase-Negative *Staphylococci* in Positive Blood Cultures by Real-Time PCR with Two Fluorescence Resonance Energy Transfer Probe Sets," Journal of Clinical Microbiology, 2004, vol. 42 (12), pp. 5739-5744.

Sambrook J., et al., "Molecular Cloning—A Laboratory Manual," 1989, Cold Spring Harbor Laboratory Press, Table of Contents.

Sampath R., et al., "Global Surveillance of Emerging Influenza Virus Genotypes by Mass Spectrometry," Plos ONE, 2007, vol. 2 (5), p. e489.

Sampath R., et al., "Rapid Identification of Emerging Infectious Agents using Pcr and Electrospray Ionization Mass Spectrometry," Annals of the New York Academy of Science, 2007, vol. 1102, pp. 109-120.

Sampath R., et al., "Rapid Identification of Emerging Pathogens: Coronavirus," Emerging Infectious Diseases, 2005, vol. 11 (3), pp. 373-379.

Sanchez A., et al., "Detection and Molecular Characterization of Ebola Viruses Causing Disease in Human and Nonhuman Primates," Journal of Infectious Diseases, 1999, vol. 179 (1), pp. S164-S169.

Sanchez J.L., et al., "Epidemic of Adenovirus-Induced Respiratory Illness Among US Military Recruits: Epidemiologic and Immunologic Risk Factors in Healthy, Young adults," Journal of Medical Virology, 2001, vol. 65 (4), pp. 710-718.

Sanchez-Seco M.P., et al., "A Generic Nested-RT-PCR followed by Sequencing for Detection and Identification of Members of the Alphavirus Genus," Journal of Virological Methods, 2001, vol. 95 (1-2), pp. 153-161.

Santos S.R., et al., "Identification and Phylogenetic Sorting of Bacterial Lineages with Universally Conserved Genes and Proteins," Environmental Microbiology, 2004, vol. 6 (7), pp. 754-759.

Sarantis H., et al., "Comprehensive Detection and Serotyping of Human Adenoviruses by PCR and Sequencing," Journal of Clinical Microbiology, 2004, vol. 42 (9), pp. 3963-3969.

Sauer S., et al., "A Novel Procedure for Efficient Genotyping of Single Nucleotide Polymorphisms," Nucleic Acids Research, 2000, vol. 28 (5), pp. E13.1-E13.8.

Schabereiter-Gurtner C., et al., "Application of Broad-Range 16s rRNA PCR Amplification and DGGE Fingerprinting for Detection of Tick-Infecting Bacteria," The Journal of Microbiological Methods, 2003, vol. 52 (2), pp. 251-260.

Scheffner M., et al., "The E6 Oncoprotein Encoded by Human Papillomavirus Types 16 and 18 Promotes the Degradation of p53," Cell, 1990, vol. 63 (6), pp. 1129-1136.

Schena M., et al., "Genome Analysis with Gene Expression Microarrays," Bioessays, 1996, vol. 18 (5), pp. 427-431.

Scheuermann R.N., et al., "Polymerase Chain-Reaction-Based mRNA Quantification Using an Internal Standard: Analysis of Oncogene Expression," Methods in Enzymology, 1993, vol. 218, pp. 446-473.

Schlecht N.F., et al., "Viral Load as a Predictor of the Risk of Cervical Intraepithelial Neoplasia," British Journal of Cancer, 2003, vol. 103 (4), pp. 519-524.

Schmitz F.J., et al., "Development of a Multiplex-PCR for Direct Detection of the Genes for Enterotoxin B and C, and Toxic Shock Syndrome Toxin-1 in *Staphylococcus Aureus* Isolates," Journal of Medical Microbiology, 1998, vol. 47 (4), pp. 335-340.

Schmitz F.J., et al., "Development of Resistance to Ciprofloxacin, Rifampin, and Mupirocin in Methicillin-Susceptible and -Resistant *Staphylococcus Aureus* Isolates," Antimicrobial Agents and Chemotherapy, 2000, vol. 44 (11), pp. 3229-3231.

Schmitz F.J., et al., "Specific Information Concerning Taxonomy, Pathogenicity and Methicillin Esistance of *Staphylococci* Obtained by a Multiplex PCR," Journal of Medical Microbiology, 1997, vol. 46 (9), pp. 773-778.

Schwartz M., et al., "Prenatal Diagnosis of Alpha-1-Antitrypsin Deficiency Using Polymerase Chainreaction (PCR). Comparison of Conventional RFLP Methods with PCR used in Combination with Allelespecific Oligonucleotides or RFLP Analysis," Clinical Genetics, 1989, vol. 36 (6), pp. 419-426.

Schweiger B., et al., "Application of a Fluorogenic PCR Assay for Typing and Subtyping of Influenza Viruses in Respiratory Samples," Journal of Clinical Microbiology, 2000, vol. 38 (4), pp. 1552-1558.

Sciacchitano C.J., "Analysis of Polymerase Chain Reaction-Amplified DNA Fragments of *Clostridium Botulinum* Type E Neurotoxin Gene by High Performance Capillary Electrophoresis," Journal of Liquid Chromatography & Related Technologies, 1996, vol. 19 (13), pp. 2165-2178.

Scott-Taylor T.H., et al., "Conserved Sequences of the Adenovirus Genome for Detection of all Human Adenovirus Types by Hybridization," Journal of Clinical Microbiology, 1992, vol. 30 (7), pp. 1703-1710.

Search Report and Written Opinion for Application No. SG2008043614, mailed on Apr. 1, 2011, 18 pages.

Sellner L., et al., "A Single-Tube Nested RT-PCR for the Detection of Ross River Virus," Methods in Molecular Biology, 1998, vol. 92, pp. 145-152.

Sellner L.N., et al., "Sensitive Detection of Ross River Virus—A One-Tube Nested RT- PCR," Journal of Virological Methods, 1994, vol. 49 (1), pp. 47-58.

Senko M.W., et al., "Determination of Monoisotopic Masses and Ion Populations for Large Biomoleculesfrom Resolved Isotopic Distributions," Journal of the American Society for Mass Spectrometry, 1995, vol. 6, pp. 229-233.

Seshadri R., et al., "Differential Expression of Translational Elements by Life Cycle Variants of *Coxiella Burnetii*," Infection and Immunity, 1999, vol. 67 (11), pp. 6026-6033.

Shadan F.F., et al., "N-Butyrate, A Cell Cycle Blocker, Inhibits the Replication of Polyomaviruses and Papillomaviruses but Not That of Adenoviruses and Herpesviruses," Journal of Virology, 1994, vol. 68 (8), pp. 4785-4796.

Shimaoka M., et al., "Detection of the Gene for Toxic Shock Syndrome Toxin 1 in *Siaphylococcusaureus* by Enzyme-Labelled Oligonucleotideprobes," Journal of Medical Microbiology, 1996, vol. 44 (3), pp. 215-218.

Shimaoka M., et al., "Development of Enzyme-Labeled Oligonucleotide Probe for Detection of MecA Gene in Methicillin-Resistant *Staphylococcus Aureus*," Journal of Clinical Microbiology, 1994, vol. 32 (8), pp. 1866-1869.

Shrestha N.K., et al., "Rapid Identification of *Staphylococcus Aureus* and the MecA Gene from BacT/ALERT Blood Culture Bottles by Using the Lightcycler System," Journal of Clinical Microbiology, 2002, vol. 40 (7), pp. 2659-2661.

Simonsen L., et al., "The Impact of Influenza Epidemics on Hospitalizations," Journal of Infectious Diseases, 2000, vol. 181 (3), pp. 831-837.

Skov R.L., et al., "Evaluation of a New 3-h Hybridization Method for Detecting the MecA Gene in *Staphylococcus Aureus* and Comparison with Existing Genotypic and Phenotypic Susceptibility Testing Methods," Journal of Antimicrobial Chemotherapy, 1999, vol. 43 (4), pp. 467-475.

Smirnov I.P., et al., "Application of DNA-Binding Polymers for Preparation of DNA for Analysis by Matrix-Assisted Laser Desorption/Ionization Mass Spectrometry," Rapid Communications in Mass Spectrometry, 2001, vol. 15 (16), pp. 1427-1432.

Smith T.F., "Comparison of Biosequences," Advances in Applied Mathematics, 1981, vol. 2, pp. 482-489.

Spackman E., et al., "Development of a Real-Time Reverse Transcriptase PCR Assay for Type A Influenzavirus and The Avian H5 and H7 Hemagglutinin Subtypes," Journal of Clinical Microbiology, 2002, vol. 40 (9), pp. 3256-3260.

Spiess L., et al., "Trehalose is a Potent PCR Enhancer: Lowering of DNA Melting Temperature and Thermal Stabilization of Taq Polymerase by the Disaccharide Trehalose," Clinical Chemistry, 2004, vol. 50 (7), pp. 1256-1259.

Stone B., et al., "Rapid Detection and Simultaneous Subtype Differentiation of Influenza A Viruses by Real Time PCR," Journal of Virological Methods, 2004, vol. 117 (2), pp. 103-112.

Stoneking M., et al., "Population Variation of Human mtDNA Control Region Sequences Detected by Enzymatic Amplification and Sequence-Specific Oligonucleotide Probes," American Journal of Human Genetics, 1991, vol. 48 (2), pp. 370-382.

Stratagene Catalog, Gene Characterization Kits, 1988, pp. 39.

Strommenger B., et al., "Multiplex PCR Assay for Simultaneous Detection of Nine Clinically Relevant Antibiotic Resistance Genes in *Staphylococcus Aureus*," Journal of Clinical Microbiology, 2003, vol. 41 (9), pp. 4089-4094.

Studdert M.J., et al., "Polymerase Chain Reaction Tests for the Identification of Ross River, Kunjin and Murray Valley Encephalitis Virus Infections in Horses," Australian Veterinary Journal, 2003, vol. 81 (1-2), pp. 76-80.

Stuhlmeier R., et al., "Fast, Simultaneous, and Sensitive Detection of *Staphylococci*," Journal of Clinical Pathology, 2003, vol. 56 (10), pp. 782-785.

Sumner J.W., et al., "PCR Amplification and Comparison of Nucleotide Sequences from the groESL Heat Shock Operon of Ehrlichia Species," Journal of Critical Microbiology, 1997, vol. 35 (8), pp. 2087-2092.

Sundsfjord A., et al., "Genetic Methods for Detection of Antimicrobial Resistance," APMIS : Acta Pathologica, Microbiologica, et Immunologica Scandinavica, 2004, vol. 112 (11-12), pp. 815-837.

Supplementary European Search Report for Application No. 04775904.8, mailed on Jul. 7, 2008, 8 pages.

Supplementary European Search Report for Application No. EP02709785.6, mailed Sep. 1, 2005, 5 pages.

Supplementary European Search Report for Application No. EP03796752.8, mailed on Aug. 7, 2007, 3 pages.

Supplementary European Search Report for Application No. EP03810055.8, mailed on Jun. 8, 2007, 4 pages.

Supplementary European Search Report for Application No. EP03814656, mailed on Oct. 16, 2007, 2 pages.

Supplementary European Search Report for Application No. EP04752257.8, mailed on Feb. 15, 2006, 2 pages.

Supplementary European Search Report for Application No. EP05753037, mailed on Aug. 21, 2009, 2 pages.

Supplementary Partial European Search Report for Application No. EP05751872.2, mailed on Jan. 28, 2008, 8 pages.

Supplementary Partial European Search Report for Application No. EP05856582.1, mailed on Oct. 27, 2008, 10 pages.

Swaminathan B., et al., "PulseNet: The Molecular Subtyping Network for Foodborne Bacterial Disease Surveillance, United States," Emerging Infectious Diseases, 2001, vol. 7 (3), pp. 382-389.

Swanborg R.H., et al., "Human Herpesvirus 6 and Chlamydia Pneumoniae as Etiologic Agents in Multiplesclerosis—A Critical Review," Microbes and Infection / Institut Pasteur, 2002, vol. 4 (13), pp. 1327-1333.

Swenson J.M., et al., "Performance of Eight Methods, Including Two New Rapid Methods, for Detection of Oxacillin Resistance in a Challenge Set of *Staphylococcus Aureus* Organisms," Journal of Clinical Microbiology, 2001, vol. 39 (10), pp. 3785-3788.

Takagaki Y., et al., "Four Factors are Required for 3"-End Cleavage of Pre-mRNAs," Genes and Development, 1989, vol. 3 (11), pp. 1711-1724.

Takahashi H., et al., "Characterization of gryA, gryB, grlA and grlB Mutations in Fluoroquinolone- Resistant Clinical Isolates of *Staphylococcus Aureus*," The Journal of Antimicrobial Chemotherapy, 1998, vol. 41 (1), pp. 49-57.

Takahata M., et al., "Mutations in the GyrA and Gr1A Genes of Quinolone-Resistant Clinical Isolates of Methicillin-Resistant *Staphylococcus Aureus*," The Journal of Antimicrobial Chemotherapy, 1996, vol. 38 (3), pp. 543-546.

Takayama R., et al., "Quantification of Adenovirus Species B and C Viremia by Real-Time PCR in Adults and Children Undergoing Stem Cell Transplantation," Journal of Medical Virology, 2007, vol. 79 (3), pp. 278-284.

Takeuchi S., et al., "Serotyping of Adenoviruses on Conjunctival Scrapings by PCR and Sequence Analysis," Journal of Clinical Microbiology, 1999, vol. 37 (6), pp. 1839-1845.

Talaat A.M., et al., "Genome-Directed Primers for Selective Labeling of Bacterial Transcripts for DNA Microarray Analysis," Nature Biotechnology, 2000, vol. 17, pp. 679- 682.

Tan T.Y., "Use of Molecular Techniques for the Detection of Antibiotic Resistance in Bacteria," Expert Review of Molecular Diagnostics, 2003, vol. 3 (1), pp. 93-103.

Tanabe F., et al., "The Properties and Mec A Gene of the Methicillin-Resistant *Staphylococcus Aureus* Isolated in Fukushima Medical College Hospital," Fukushima Journal of Medical Science, 1993, vol. 39 (1), pp. 35-42.

Tang K., et al., "Detection of 500-Nucleotide DNA by Laser Desorption Mass Spectrometry," Rapid Communications in Mass Spectrometry, 1994, vol. 8 (9), pp. 727-730.

Tang K., et al., Double-Stranded DNA Analysis by Matrix Assisted Laser Desorption/Ionization, 42nd ASMS Conference on Mass Spectrometry, 1994.

Tang K., et al., "Matrix-Assisted Laser Desorption/Ionization of Restriction Enzyme-Digested DNA," Rapid Communications in Mass Spectrometry, 1994, vol. 8 (2), pp. 183-186.

Tang K., et al., Matrix-Assisted Laser Desorption/Ionization Mass Spectrometry of Oligonucleotides, Dissertation submitted to the Faculty of Vanderbilt University, 1994.

Tarassishin L., et al., "Adenovirus Core Protein VII Displays a Linear Epitope Conserved in a Range of Human Adenoviruses," Journal of General Virology, 1999, vol. 80 (Pt 1), pp. 47-50.

Tarassishin L., et al., "An Epitope on the Adenovirus Fibre Tail is Common to all Human Subgroups," Archives of Virology, 2000, vol. 145 (4), pp. 805-811.

Tatuch Y., et al., "Heteroplasmic mtDNA Mutation (T-G) at 8993 Can Cause Leigh Disease When the Percentage of Abnormal mtDNA is High," The American Journal of Human Genetics, 1992, vol. 50 (4), pp. 852-858.

Taubenberger J.K., et al., "Characterization of the 1918 Influenza Virus Polymerase Genes," Nature, 2005, vol. 437 (7060), pp. 889-893.

Taylor L.H., et al., "Risk Factors for Human Disease Emergence," Philosophical Transactions of the Royal Society of London Series B, Biological Sciences, 2001, vol. 356 (1411), pp. 983-989.

Tenover F.C., et al., "Characterization of a Strain of Community-Associated Methicillin-Resistant*Slaphylococcus Aureus* Widely Disseminated in the United States," Journal of Clinical Microbiology, 2006, vol. 44 (1), pp. 108-118.

Teramura T., et al., "Quantitative Detection of Serum Adenovirus in a Transplant Recipient," Lancet, 2002, vol. 359 (9321), p. 1945.

Thompson J.D., et al., "Clustal W: Improving the Sensitivity of Progressive Multiple Sequence Alignmen Through Sequence Weighting, Position-Specific Gap Penalties and Weight Matrix Choice," Nucleic Acids Research, 1994, vol. 22 (22), pp. 4673-4680.

Thompson W.W., et al., "Influenza-Associated Hospitalizations in the United States," The Journal of the American Medical Association, 2004, vol. 292 (11), pp. 1333-1340.

Tokue Y., et al., "Comparison of a Polymerase Chain Reaction Assay and a Conventional Microbiologic Method for Detection of Methicillin-Resistant *Slaphylococcus Aureus*," Antimicrobial Agents and Chemotherapy, 1992, vol. 36 (1), pp. 6-9.

Tong J., et al., "Ligation Reaction Specificities of an NAD+-Dependent DNA Ligase from the Hyperthermophile Aquifex Aeolicus," Nucleic Acids Research, 2000, vol. 28 (6), pp. 1447-1454.

Top F.H Jr., "Control of Adenovirus Acute Respiratory Disease in U.S. Army Trainees," The Yale Journal of Biology and Medicine, 1975, vol. 48 (3), pp. 185-195.

Torroni A., et al., "Classification of European mtDNAs from an Analysis of Three European Populations," Genetics, 1996, vol. 144 (4), pp. 1835-1850.

Towner K.J., et al., "Development and Evaluation of a PCR-Based Immunoassay for the Rapid Detection of Methicillin-Resistant *Staphylococcus Aureus*," Journal of Medical Microbiology, 1998, vol. 47 (7), pp. 607-613.

Tsunoda T., et al., "Time and Memory Efficient Algorithm for Extracting Palindromic and RepetitiveSubsequences in Nucleic Acid Sequences," Pacific Symposium on Biocomputing, 1999, vol. 4, pp. 202-213.

Udo E.E., et al., "A Chromosomal Location of the MupA Gene in *Staphylococcus Aureus* Expressing High-Level Mupirocin Resistance," The Journal of Antimicrobial Chemotherapy, 2003, vol. 51 (5), pp. 1283-1286.

Udo E.E., et al., "Genetic Analysis of Methicillin-Resistant *Staphylococcus Aureus* Expressing High-and Low-Level Mupirocin Resistance," Journal of Medical Microbiology, 2001, vol. 50 (10), pp. 909-915.

Udo E.E., et al., "Rapid Detection of Methicillin Resistance in *Staphylococci* Using a Slide Latex Agglutination Kit," International Journal of Antimicrobial Agents, 2000, vol. 15 (1), pp. 19-24.

Unal S., et al., "Detection of Methicillin-Resistant *Staphylococci* by Using the Polymerase Chain Reaction," Journal of Clinical Microbiology, 1992, vol. 30 (7), pp. 1685-1691.

Upton A., et al., "Mupirocin and *Staphylococcus Aureus*: A Recent Paradigm of Emerging Antibiotic Resistance," the Journal of Antimicrobial Chemotherapy, 2003, vol. 51 (3), pp. 613-617.

Vabret a., et al., "Development of a PCR-and Hybridization-Based Assay (PCR Adenovirus Consensus) for the Detection and the Species Identification of Adenoviruses in Respiratory Specimens," Journal of Clinical Virology, 2004, vol. 31 (2), pp. 116-122.

Van Der Vossen J.M., et al., "DNA Based Typing Identification and Detection Systems for Food Spoilage Microorganisms: Development and Implementation," International Journal of Food Microbiology, 1996, vol. 33 (1), pp. 35-49.

Van Der Zee H., et al., "Rapid and Alternative Screening Methods for Microbiological Analysis," Journal of AOSC International, 1997, vol. 80 (4), pp. 934-940.

Van Elden L.J., et al., "Clinical Diagnosis of Influenza Virus Infection: Evaluation of Diagnostic Tools in General Practice," The British Journal of General Practice, 2001, vol. 51 (469), pp. 630-634.

Van Elden L.J., et al., "Simultaneous Detection of Influenza Viruses A and B Using Real-Time Quantitative PCR," Journal of Clinical Microbiology, 2001, vol. 39 (1), pp. 196-200.

Van Ert M.N., et al., "Mass Spectrometry Provides Accurate Characterization of Two Genetic Marker Types in Bacillus Anthracis," Bio Techniques, 2004, vol. 37 (4), pp. 642-651.

Van Leeuwen W.B., et al., "Multilocus Sequence Typing of *Staphylococcus Aureus* with DNA Array Technology," Journal of Clinical Microbiology, 2003, vol. 41 (7), pp. 3323-3326.

Van Leeuwen W.B., et al., "Rapid Detection of Methicillin-Resistance in *Staphylococcus Aureus* Isolates by the MRSA-Screen Latex Agglutination Test," Journal of Clinical Microbiology, 1999, vol. 37 (9), pp. 3029-3030.

Vanchiere J.A., et al., "Detection of BK Virus and Simian Virus 40 in the Urine of Healthy Children," Journal of Medical Virology, 2005, vol. 75 (3), pp. 447-454.

Van Derhallen H., et al. "Identification of Encephalomyocarditis Virus in Clinical Samples by ReverseTranscription-PCR Followed by Genetic Typing Using Sequence Analysis," Journal of Clinical Microbiology, 1998, vol. 36 (12), pp. 3463-3467.

Vannuffel P., et al., "Rapid and Specific Molecular Identification of Methicillin-Resistant *Staphylococcus Aureus* in Endotracheal Aspirates from Mechanically Ventilated Patients," Journal of Clinical Microbiology, 1998, vol. 36 (8), pp. 2366-2368.

Vannuffel P., et al., "Specific Detection of Methicillin-Resistant *Staphylococcus* Species by Multiplex PCR," Journal of Clinical Microbiology, 1995, vol. 33 (11), pp. 2864-2867.

Verma S., et al., "Modified Oligonucleotides: Synthesis and Strategy for Users," Annual Review of Biochemistry, 1998, vol. 67, pp. 99-134.

Videla C., et al., "Genomic Analysis of Adenovirus Isolated from Argentinian Children with Acute Lower Respiratory Infections," Journal of Clinical Virology, 1999, vol. 14 (1), pp. 67-71.

Vilchez R.A. et al., "Detection of Polyomavirus Simian Virus 40 Tumor Antigen DNA in AIDS-Related Systemic Non-Hodgkin Lymphoma," Journal of Acquired Immune Deficiency Syndromes, 2002, vol. 29 (2), pp. 109-116.

Voelter C., et al., "Screening Human Tumor Samples with a Broad-Spectrum Polymerase Chain Reaction Method for the Detection of Polyomaviruses," Virology, 1997, vol. 237 (2), pp. 389-396.

Volokhov D., et al., "Microarray Analysis of Erythromycin Resistance Determinants," Journal of Applied Microbiology, 2003, vol. 95 (4), pp. 787-798.

Von Eiff C., et al., "Pathogenesis of Infections Due to Coagulase-Negative *Staphylococci*," The Lancet Infectious Diseases, 2002, vol. 2 (11), pp. 677-685.

Von Wintzingerode F., et al., "Base-Specific Fragmentation of Amplified 16S rRNA Genes Analyzed by Mass Spectrometry: A Tool for Rapid Bacterial Identification," Proceedings of the National Academy of Sciences, 2002, vol. 99 (10), pp. 7039-7044.

Walker E.S., et al., "A Decline in Mupirocin Resistance in Methicillin-Resistant *Staphylococcus aureus* Accompanied Administrative Control of Prescriptions," Journal of Clinical Microbiology, 2004, vol. 42 (6), pp. 2792-2795.

Wallace S.S., et al., "The Enigma of Endonuclease VIII," DNA Repair, 2003, vol. 2 (5), pp. 441-453.

Wallet F., et al., "Choice of a Routine Method for Detecting Methicillin-Resistance in *Staphylococci*," The Journal of Antimicrobial Chemotherapy, 1996, vol. 37 (5), pp. 901-909.

Wang G., et al., "Targeted Mutagenesis in Mammalian Cells Mediated by Intracellular Triple Helix Formation," Molecular and Cellular Biology, 1995, vol. 15 (3), pp. 1759-1768.

Ward C.L., et al., "Design and Performance Testing of Quantitative Real Time PCR Assays for Influenza A and B Viral Load Measurement," Journal of Clinical Virology, 2004, vol. 29 (3), pp. 179-188.

Watanabe K., et al., "ICB Database: The gyrB Database for Identification and Classification of Bacteria," Nucleic Acids Research, 2001, vol. 29 (1), pp. 344-345.

Weissenbacher M., et al., "Etiologic and Clinical Evaluation of Acute Lower Respiratory TractInfections in Young Argentinean Children: An Overview," Reviews of Infectious Diseases, 1990, vol. 12 (Suppl 8), pp. S889-S898.

Wertheim H.F., et al., "Effect of Mupirocin Treatment on Nasal, Pharyngeal, and Perineal Carriage of *Staphylococcus Aureus* in Healthy Adults," Antimicrobial Agents and Chemotherapy, 2005, vol. 49 (4), pp. 1465-1467.

Westermann P., et al., "Inhibition of Expression of SV40 Virus Large T-Antigen by Antisense Oligodeoxyribonucleotides," Biomedica Biochimica Acta, 1989, vol. 1, pp. 85-93.

Whiley D.M., et al., "Simultaneous Detection and Differentiation of Human Polyomaviruses JC and BK by a Rapid and Sensitive PCR-ELAHA Assay and a Survey of the JCV Subtypes within an Australian Population," Journal of Medical Virology, 2004, vol. 72 (3), pp. 467-472.

Wichelhaus T.A., et al., "Rapid Detection of Epidemic Strains of Methicillin-Resistant*Staphylococcus Aureus*," Journal of Clinical Microbiology, 1999, vol. 37 (3), pp. 690-693.

Wickham T.J., "Targeting Adenovirus," Gene Therapy, 2000, vol. 7 (2), pp. 110-114.

Widjojoatmodjo M.N., et al., "Rapid Identification of Bacterial by PCR-Single-Strand Conformation Polymorphism," Journal of Clinical Microbiology, 1994, vol. 32 (12), pp. 3002-3007.

Widjojoatmodjo M.N., et al., "The Magnetic Immuno Polymerase Chain Reaction Assay for Direct Detection of Salmonellae in Fecal Samples," Journal of Clinical Microbiology, 1992, vol. 30 (12), pp. 3195-3199.

Winger B.E., et al., "High Resolution Accurate Mass Measurements of Biomolecules using a new Electrospray Ionization Ion Cyclotron Resonance Mass Spectrometer," Journal American Society for Mass Spectrometry, 1993, vol. 4 (7), pp. 566-577.

Wood S.R., et al., "Rapid Detection and Serotyping of Adenovirus by Direct Immunofluorescence," Journal of Medical Virology, 1997, vol. 51 (3), pp. 198-201.

Wright K.E., et al., "Typing and Subtyping of Influenza Viruses in Clinical Samples by PCR," Journal of Clinical Microbiology, 1995, vol. 33 (5), pp. 1180-1184.

Written Opinion for Application No. PCT/US2004/33742, mailed on May 15, 2006, 5 pages.

Wu S., et al., "Genetic Organization of the mecA Region in Methicillin-Susceptible and Methicillin-Resistant Strains of *Staphylococcus Sciuri*," The Journal of Bacteriology, 1998, vol. 180 (2), pp. 236-242.

Wunschel D., et al., "Discrimination Among the B. Cereus Group, in Comparison to B. Subtilis, by Structural Carbohydrate Profiles and Ribosomal RNA Spacer Region PCR," Systematic and Applied Microbiology, 1994, vol. 17, pp. 625-635.

Xu L., et al., "Electrophore Mass Tag Dideoxy DNA Sequencing," Analytical Chemistry, 1997, vol. 69 (17), pp. 3595-3602.

Xu W., et al., "Species-Specific Identification of Human Adenoviruses by a Multiplex PCR Assay," Journal of Clinical Microbiology, 2000, vol. 38 (11), pp. 4114-4120.

Xu W., et al., "Type-Specific Identification of Human Adenovirus, 3, 7, and 21 by a Multiplex PCR Assay," Journal of Medical Virology, 2001, vol. 64 (4), pp. 537-542.

Xu X., et al., "Intercontinental Circulation of Human Influenza A(H1N2) Reassortant Viruses During the 2001-2002 Influenza Season," The Journal of Infectious Diseases, 2002, vol. 186 (10), pp. 1490-1493.

Yao Z.P., et al., "Mass Spectrometry Based Proteolytic Mapping for Rapid Virus Identification," Analytical Chemistry, 2002, vol. 74 (11), pp. 2529-2534.

Ye K., et al., "Three Distinct Promoters Direct Transcription of Different 5" Untranslated Regions of the Human Interleukin 1 Type 1 Receptor. A Possible Mechanism for Control of Translation," Cytokine, 1996, vol. 8 (6), pp. 421-429.

Yun H.J., et al., "Increased Antibacterial Activity of OW286, A Novel Fluoronaphthyridone Antibiotic, Against *Staphylococcus Aureus* Strains with Defined Mutations in DNA Gyrase and Toposiomerase IV," International Journal of Antimicrobial Agents, 2005, vol. 25 (4), pp. 334-337.

Zeng Z.B., "Precision Mapping Quantitative Trait Loci," vol. 136 (4), pp. 1457-1468.

Zhang J., et al., "PowerBLAST: A New Network Blast Application for Interactive or Automated Sequence Analysis and Annotation," Genome Research, 1997, vol. 7 (6), pp. 649-656.

Zhang K., et al., "New Quadriplex PCR Assay for Detection of Methicillin and Mupirocin Resistance and Simultaneous Discrimination of *Staphylococcus Aureus* from Coagulase-Negative *Staphylococci*," Journal of Clinical Microbiology, 2004, vol. 42 (11), pp. 4947-4955.

Zhang W.D., et al., "Detection and Identification of Human Influenza Viruses by the Polymerase Chain Reaction," Journal of Virological Methods, 1991, vol. 33 (1-2), pp. 165-189.

Zhang Y.Q., et al., "Genome-Based Analysis of Virulence Genes in a Non-Biofilm-Forming *Staphylococcus Epidemidis* Stain (ATCC 12228)," Molecular Microbiology, 2003, vol. 49 (6), pp. 1577-1593.

Ziebuhr J., et al., "Virus-Encoded Proteinases and Proteolytic Processing in the Nidovirales," Journal of General Virology, 2000, vol. 81 (Pt 4), pp. 853-879.

Examiner Interview Summary mailed Jun. 7, 2011 U.S. Appl. No. 11/930,108, filed Oct. 31, 2007.

Final Office Action mailed Jun. 14, 2011 for U.S. Appl. No. 12/616,422, filed Nov. 11, 2009.

"International Preliminary Reporton Patentabililty and Written Opinion for Application No. PCT/US04/007236, mailed on Mar. 16, 2006, 7 pages.".

International Preliminary Reporton Patentabililty for Application No. PCT/US2005/018031, mailed Nov. 29, 2006, 1 page.

Notice of Allowance mailed Jun. 9, 2011 for U.S. Appl. No. 11/331,987, filed Jan. 13, 2006.

Notice of Allowance mailed Jun. 9, 2011 for U.S. Appl. No. 11/491,376, filed Jul. 21, 2006.

Office Action mailed Feb. 15, 2011 for European Application No. 04775904.8 filed Apr. 23, 2004.

Office Action mailed Feb. 24, 2011 for Canadian Application No. 2521508 filed Apr. 23, 2004.

Taranenko N.I., et al., "Laser Desorption Mass Spectrometry for Microbial DNA Analysis," Journal of Microbiological Methods, 2002, vol. 48 (2-3), pp. 101-106.

* cited by examiner

FIG. 5

B. anthracis ($A_{14}G_9C_{14}T_9$) $MW_{meas} = 14072.2$)

B. anthracis* ($A_1A^*{}_{13}G_9C_{14}T_9$) $MW_{meas} = 14280.9$)

METHODS FOR IDENTIFICATION OF CORONAVIRUSES

CROSS-REFERENCE TO RELATED APPLICATIONS

This application claims the benefit of priority to: 1) U.S. application Ser. No. 60/466,009 filed Apr. 26, 2003; 2) U.S. application Ser. No. 60/467,768 filed May 2, 2003; 3) U.S. application Ser. No. 60/468,743 filed May 7, 2003 and 4) U.S. application Ser. No. 60/542,510 filed Feb. 6, 2004, each of which is incorporated herein by reference in its entirety.

REFERENCE TO SEQUENCE LISTING SUBMITTED ON COMPACT DISK

A Sequence Listing is being filed in electronic format. The Sequence Listing is provided as a file entitled DIBIS0058USSEQ3.txt created Jan. 8, 2006 which is 2.42 Mb in size. The information in the electronic format of the sequence listing is incorporated herein by reference in its entirety.

FIELD OF THE INVENTION

The present invention relates generally to the field of genetic identification and quantitation of coronaviruses and provides methods, compositions and kits useful for this purpose when combined with molecular mass analysis.

BACKGROUND OF THE INVENTION

Coronaviruses, a genus in the family Coronoviridae, are large, enveloped RNA viruses that cause highly prevalent diseases in humans and domestic animals. Coronavirus particles are irregularly-shaped, 60-220 nm in diameter, with an outer envelope bearing distinctive, "club-shaped" peplomers. This "crown-like" appearance gives the family its name. Coronaviruses have the largest genomes of all RNA viruses and replicate by a unique mechanism which results in a high frequency of recombination. Virions mature by budding at intracellular membranes and infection with some coronaviruses induces cell fusion.

Most human coronaviruses (HcoVs) do not grow in cultured cells, therefore relatively little is known about them, but two strains (229E and OC43) grow in some cell lines and have been used as a model. Replication is slow compared to other enveloped viruses. Viral entry occurs via endocytosis and membrane fusion (probably mediated by E2) and replication occurs in the cytoplasm.

Initially, the 5' 20 kb of the (+)sense genome is translated to produce a viral polymerase, which is believed to produce a full-length (−)sense strand which, in turn, is used as a template to produce mRNA as a "nested set" of transcripts, all with an identical 5' non-translated leader sequence of 72 nucleotides and coincident 3' polyadenylated ends. Each mRNA is monocistronic, the genes at the 5' end being translated from the longest mRNA. These unusual cytoplasmic structures are produced not by splicing (post-transcriptional modification) but by the polymerase during transcription.

Coronaviruses infect a variety of mammals and birds. The exact number of human isolates is not known as many cannot be grown in culture. In humans, they cause: respiratory infections (common), including Severe Acute Respiratory Syndrome (SARS), and enteric infections.

Coronaviruses are transmitted by aerosols of respiratory secretions, by the fecal-oral route, and by mechanical transmission. Most virus growth occurs in epithelial cells. Occasionally the liver, kidneys, heart or eyes may be infected, as well as other cell types such as macrophages. In cold-type respiratory infections, growth appears to be localized to the epithelium of the upper respiratory tract, but there is currently no adequate animal model for the human respiratory coronaviruses. Clinically, most infections cause a mild, self-limited disease (classical "cold" or upset stomach), but there may be rare neurological complications.

Coronavirus infection is very common and occurs worldwide. The incidence of infection is strongly seasonal, with the greatest incidence in children in winter. Adult infections are less common. The number of coronavirus serotypes and the extent of antigenic variation are unknown. Re-infections appear to occur throughout life, implying multiple serotypes (at least four are known) and/or antigenic variation, hence the prospects for immunization appear bleak.

SARS (Severe Acute Respiratory Syndrome) is a newly-recognized type of viral *pneumonia*, with symptoms including fever, a dry cough, dyspnea (shortness of breath), headache, and hypoxemia (low blood oxygen concentration). Typical laboratory findings include lymphopenia (reduced lymphocyte numbers) and mildly elevated aminotransferase levels (indicating liver damage). Death may result from progressive respiratory failure due to alveolar damage.

The outbreak is believed to have originated in February 2003 in the Guangdong province of China. After initial reports that a paramyxovirus was responsible, researchers now believe SARS to causally-linked with a type of novel coronavirus with some unusual properties. For example, the SARS virus can be grown in Vero cells (a primate fibroblast cell line)—a novel property for HCoVs, most of which cannot be cultivated. In these cells, virus infection results in a cytopathic effect, and budding of coronavirus-like particles from the endoplasmic reticulum within infected cells.

Amplification of short regions of the polymerase gene, (the most strongly conserved part of the coronavirus genome) by reverse transcriptase polymerase chain reaction (RT-PCR) and nucleotide sequencing revealed that the currently evaluated examples of the SARS virus are of a novel coronavirus which has not previously been present in human populations.

Different isolates of coronaviruses that have been causally linked to SARS have been independently sequenced by BCCA Genome Sciences Center, Vancouver, Canada; the Institute of Microbiology and Epidemiology, Academy of Military Medical Sciences/Beijing Genomics Institute, Chinese Academy of Sciences, Beijing, China; the Centers for Disease Control and Prevention (CDC), Atlanta; the Chinese University of Hong Kong; and the University of Hong Kong. As new SARS-linked coronavirus samples are obtained and sequenced, and as the initial SARS coronaviruses mutate, other coronavirus sequences causally-linked to SARS will emerge.

While the SARS epidemic is still at the early stages, Ruan et al have identified a number of variations in existing SARS CoV isolates that suggest the emergence of new genotypes (Y. Ruan et al., *Lancet*, May 9, (2003)). This phenomenon is likely to continue if SARS CoV passes through the human population and will have a detrimental impact on detection and treatment. Additional primers that flank regions of high variability could be valuable in epidemiological tracking of strain variants. Moreover, as loci important to virulence become identified, primers that flank these locations could provide valuable information.

Diagnostic tests are now available, but all have limitations as tools for bringing this outbreak quickly under control. An ELISA test detects antibodies reliably but only from about day 20 after the onset of clinical symptoms. It therefore cannot be used to detect cases at an early stage prior to spread of the infection to others. The second test, an immunofluorescence assay (IFA), detects antibodies reliably as of day 10 of infection. It shares the defect of the ELISA test in that test subjects have become infective prior to IFA-based diagnosis. Moreover, the IFA test is a demanding and comparatively slow test that requires the growth of virus in cell culture. The third test is a polymerase chain reaction (PCR) molecular test for detection of SARS virus genetic material is useful in the early stages of infection but undesirably produces false-negatives. Thus the PCR test may fail to detect persons who actually carry the virus, even in conjunction with clinical diagnostic evaluation, creating a dangerous sense of false security in the face of a potential epidemic of a virus that is known to spread easily in close person-to-person contact (WHO. Severe acute respiratory syndrome (SARS). *Wkly Epidemiol. Rec.* 2003, 78, 121-122).

Nucleic acid tests for infectious diseases are largely based upon amplifications using primers and probes designed to detect specific bioagents. Because prior knowledge of nucleic acid sequence information is required to develop these tests they are not able to identify unanticipated, newly emergent, or previously unknown infectious bioagents. Thus, the initial discovery of infectious bioagents still relies largely on culture and microscopy, which were as important in the recent identification of the SARS coronavirus as they were in the discovery of the human immunodeficiency virus two decades ago.

An alternative to single-agent tests is to do broad-range consensus priming of a gene target conserved across groups of bioagents. Broad-range priming has the potential to generate amplification products across entire genera, families, or, as with bacteria, an entire domain of life. This strategy has been successfully employed using consensus 16S ribosomal RNA primers for determining bacterial diversity, both in environmental samples (T. M. Schmidt, T. M., DeLong, E. F., Pace, N. R. *J. Bact.* 173, 4371-4378 (1991)) and in natural human flora (Kroes, I., Lepp, P. W., Relman, D. A. *Proc Nat Acad Sci* (*USA*) 96, 14547-14552 (1999)). The drawback of this approach for unknown bioagent detection and epidemiology is that analysis of the PCR products requires the cloning and sequencing of hundreds to thousands of colonies per sample, which is impractical to perform rapidly or on a large number of samples.

Consensus priming has also been described for detection of several viral families, including coronaviruses (Stephensen, C. B., Casebolt, D. B. Gangopadhyay, N. N. *Vir. Res.* 60, 181-189 (1999)), enteroviruses (M. S. Oberste, K. Maher, M. A. Pallansch, *J. Virol.* 76, 1244-51 (2002); M. S. Oberste, W. A. Nix, K. Maher, M. A. Pallansch, *J. Clin. Virol.* 26, 375-7 (2003); M. S. Oberste, W. A. Nix, D. R. Kilpatrick, M. R. Flemister, M. A. Pallansch, Virus Res. 91, 241-8(2003)), retroid viruses (D. H. Mack, J. J. Sninsky, *Proc. Natl. Acad. Sci. U.S.A.* 85, 6977-81 (1988); W. Seifarth et al., *AIDS Res. Hum. Retroviruses* 16, 721-729 (2000); L. A. Donehower, R. C. Bohannon, R. J. Ford, R. A. Gibbs, *J. Vir. Methods* 28, 33-46 (1990)), and adenoviruses (M. Echavarria, M. Forman, J. Ticehurst, S. Dumler, P. Charache, *J. Clin. Micro.* 36, 3323-3326 (1998)). However, as with bacteria, there is no adequate analytical method other than sequencing to identify the viral bioagent present.

Methods of identification of bioagents are described in U.S. patent application Ser. No. 09/798,007, filed Mar. 3, 2001; Ser. No. 10/405,756, filed Mar. 31, 2003; Ser. No. 10/660,122, filed Sep. 11, 2003; and Ser. No. 10/728,486, filed Dec. 5, 2003, all of which are commonly owned and incorporated herein by reference in entirety as essential material.

Mass spectrometry provides detailed information about the molecules being analyzed, including high mass accuracy. It is also a process that can be easily automated. However, high-resolution MS alone fails to perform against unknown or bioengineered agents, or in environments where there is a high background level of bioagents ("cluttered" background). Low-resolution MS can fail to detect some known agents, if their spectral lines are sufficiently weak or sufficiently close to those from other living organisms in the sample. DNA chips with specific probes can only determine the presence or absence of specifically anticipated organisms. Because there are hundreds of thousands of species of benign bacteria, some very similar in sequence to threat organisms, even arrays with 10,000 probes lack the breadth needed to detect a particular organism.

Antibodies face more severe diversity limitations than arrays. If antibodies are designed against highly conserved targets to increase diversity, the false alarm problem will dominate, again because threat organisms are very similar to benign ones. Antibodies are only capable of detecting known agents in relatively uncluttered environments.

Several groups have described detection of PCR products using high resolution electrospray ionization—Fourier transform—ion cyclotron resonance mass spectrometry (ESI-FT-ICR MS). Accurate measurement of exact mass combined with knowledge of the number of at least one nucleotide allowed calculation of the total base composition for PCR duplex products of approximately 100 base pairs. (Aaserud et al., *J. Am. Soc. Mass Spec.* 7:1266-1269, 1996; Muddiman et al., *Anal. Chem.* 69:1543-1549, 1997; Wunschel et al., *Anal. Chem.* 70:1203-1207, 1998; Muddiman et al., *Rev. Anal. Chem.* 17:1-68, 1998). Electrospray ionization-Fourier transform-ion cyclotron resistance (ESI-FT-ICR) MS may be used to determine the mass of double-stranded, 500 base-pair PCR products via the average molecular mass (Hurst et al., *Rapid Commun. Mass Spec.* 10:377-382, 1996). The use of matrix-assisted laser desorption ionization-time of flight (MALDI-TOF) mass spectrometry for characterization of PCR products has been described. (Muddiman et al., *Rapid Commun. Mass Spec.* 13:1201-1204, 1999). However, the degradation of DNAs over about 75 nucleotides observed with MALDI limited the utility of this method.

U.S. Pat. No. 5,849,492 describes a method for retrieval of phylogenetically informative DNA sequences which comprise searching for a highly divergent segment of genomic DNA surrounded by two highly conserved segments, designing the universal primers for PCR amplification of the highly divergent region, amplifying the genomic DNA by PCR technique using universal primers, and then sequencing the gene to determine the identity of the organism.

U.S. Pat. No. 5,965,363 discloses methods for screening nucleic acids for polymorphisms by analyzing amplified target nucleic acids using mass spectrometric techniques and to procedures for improving mass resolution and mass accuracy of these methods.

WO 99/14375 describes methods, PCR primers and kits for use in analyzing preselected DNA tandem nucleotide repeat alleles by mass spectrometry.

WO 98/12355 discloses methods of determining the mass of a target nucleic acid by mass spectrometric analysis, by cleaving the target nucleic acid to reduce its length, making the target single-stranded and using MS to determine the mass of the single-stranded shortened target. Also disclosed are methods of preparing a double-stranded target nucleic acid for MS analysis comprising amplification of the target nucleic acid, binding one of the strands to a solid support, releasing the second strand and then releasing the first strand which is then analyzed by MS. Kits for target nucleic acid preparation are also provided.

PCT WO97/33000 discloses methods for detecting mutations in a target nucleic acid by nonrandomly fragmenting the target into a set of single-stranded nonrandom length fragments and determining their masses by MS.

U.S. Pat. No. 5,605,798 describes a fast and highly accurate mass spectrometer-based process for detecting the presence of a particular nucleic acid in a biological sample for diagnostic purposes.

WO 98/21066 describes processes for determining the sequence of a particular target nucleic acid by mass spectrometry. Processes for detecting a target nucleic acid present in a biological sample by PCR amplification and mass spectrometry detection are disclosed, as are methods for detecting a target nucleic acid in a sample by amplifying the target with primers that contain restriction sites and tags, extending and cleaving the amplified nucleic acid, and detecting the presence of extended product, wherein the presence of a DNA fragment of a mass different from wild-type is indicative of a mutation. Methods of sequencing a nucleic acid via mass spectrometry methods are also described.

WO 97/37041, WO 99/31278 and U.S. Pat. No. 5,547,835 describe methods of sequencing nucleic acids using mass spectrometry. U.S. Pat. Nos. 5,622,824, 5,872,003 and 5,691,141 describe methods, systems and kits for exonuclease-mediated mass spectrometric sequencing.

The present invention provides a novel approach for rapid, sensitive, and high-throughput identification of coronaviruses and includes the capability of identification of coronaviruses not yet observed and characterized. The methods described can be applied to additional viral families to cover a broad range of potential newly emerging viruses, or to bacterial, protozoal or fungal pathogens for epidemic disease surveillance in the future.

SUMMARY OF THE INVENTION

The present invention is directed to, inter alia, methods of identification of one or more unknown coronaviruses in a sample by obtaining coronavirus RNA from the sample, obtaining corresponding DNA from the RNA, amplifying the DNA with one or more pairs of oligonucleotide primers that bind to conserved regions of a coronavirus genome which are flanked a variable region of the coronavirus genome, determining the molecular masses or base compositions of the one or more amplification products and comparing the molecular masses or base compositions with calculated or experimentally determined molecular masses or base compositions, wherein one or more matches identifies the unknown coronavirus.

The present invention is also directed to methods of tracking the spread of a specific coronavirus comprising: obtaining a plurality of samples containing a specific coronavirus from a plurality of different locations, identifying the specific coronavirus in a subset of the plurality of samples using the method described in the paragraph above, wherein the corresponding locations of the members of the subset indicate the spread of the specific coronavirus to the corresponding locations.

The present invention is also directed to pairs of primers wherein each member of each pair has at least 70% sequence identity with the sequence of the corresponding member of any one of the following intelligent primer pair sequences: SEQ ID NOs: 5:6, 7:8, 9:8, 9:10, 11:8, 11:10 or 9:10. The present invention is also directed to individual primers within each of the primer pairs described herein.

The present invention is also directed to bioagent identifying amplicons for identification of a coronavirus comprising an isolated polynucleotide of about 45 to about 150 nucleobases in length produced by the process of amplification of nucleic acid from a coronavirus genome with a primer pair wherein each primer of the pair is of a length of about 12 to about 35 nucleobases and the bioagent identifying amplicon provides identifying information about the coronavirus.

The present invention is also directed to methods for simultaneous determination of the identity and quantity of an unknown coronavirus in a sample comprising: contacting a sample with a pair of primers and a known quantity of a calibration polynucleotide comprising a calibration sequence, simultaneously amplifying nucleic acid from the unknown coronavirus with the pair of primers and amplifying nucleic acid from the calibration polynucleotide in the sample with the pair of primers to obtain a first amplification product comprising a bioagent identifying amplicon and a second amplification product comprising a calibration amplicon, subjecting the sample to molecular mass analysis wherein the result of the mass analysis comprises molecular mass and abundance data for the bioagent identifying amplicon and the calibration amplicon, and distinguishing the bioagent identifying amplicon from the calibration amplicon based on molecular mass wherein the molecular mass of the bioagent identifying amplicon identifies the coronavirus and comparison of bioagent identifying amplicon abundance data and calibration amplicon abundance data indicates the quantity of coronavirus in the sample.

The present invention is also directed to isolated polynucleotides for determining the quantity of a bioagent in a sample comprising SEQ ID NOs: 102, and 103 as well as vectors comprising of SEQ ID NOs: 102, 103 and 104.

The present invention is also directed to kits comprising one or more pairs of primers, or individual primers, wherein each member of each pair has at least 70% sequence identity with the sequence of the corresponding member of any one of the following intelligent primer pair sequences: SEQ ID NOs: 5:6, 7:8, 9:8, 9:10, 11:8, 11:10 or 9:10.

115; SEQ ID NO: 116; SEQ ID NO: 117; SEQ ID NO: 118; SEQ ID NO: 119; SEQ ID NO: 120; SEQ ID NO: 121; SEQ ID NO: 122; SEQ ID NO: 123; SEQ ID NO: 124; SEQ ID NO: 125; SEQ ID NO: 126; SEQ ID NO: 127; SEQ ID NO: 128; SEQ ID NO: 129; SEQ ID NO: 130, SEQ ID NO: 131; and SEQ ID NO: 132. The nucleotide sequence of the 16S rRNA consensus sequence is SEQ ID NO:3. The nucleotide sequence for the 23S rRNA (FIGS. 1B to 1H) are, sequentially from the 5' end to the 3' end, the following: SEQ ID NO:, 133; SEQ ID NO: 134; SEQ ID NO: 135; SEQ ID NO: 136; SEQ ID NO: 137; SEQ ID NO: 138; SEQ ID NO: 139; SEQ ID NO: 140; SEQ ID NO: 141; SEQ ID NO: 142; SEQ ID NO: 143; SEQ ID NO: 144; SEQ ID NO: 145; SEQ ID NO: 146; SEQ ID NO: 147; SEQ ID NO: 148; SEQ ID NO: 149; SEQ ID NO: 150; SEQ ID NO: 151; SEQ ID NO: 152; SEQ ID NO: 153; SEQ ID NO: 154; SEQ ID NO: 155; SEQ ID NO: 156; SEQ ID NO: 157; SEQ ID NO: 158; SEQ ID NO: 159; SEQ ID NO: 160; SEQ ID NO: 161; SEQ ID NO: 162; SEQ ID NO: 163; SEQ ID NO: 164; SEQ ID NO: 165; SEQ ID NO: 166; SEQ ID NO: 167; SEQ ID NO: 168; SEQ ID NO: 169; SEQ ID NO: 170; SEQ ID NO: 171; SEQ ID NO: 172; SEQ ID NO: 173; SEQ ID NO: 174; SEQ ID NO: 175; SEQ ID NO: 176; SEQ ID NO: 177; SEQ ID NO: 178; SEQ ID NO: 179; SEQ ID NO: 180; SEQ ID NO: 181; SEQ ID NO: 182; SEQ ID NO: 183; SEQ ID NO: 184; SEQ ID NO: 185; SEQ ID NO: 186; SEQ ID NO: 187; SEQ ID NO: 188; SEQ ID NO: 189; SEQ ID NO: 190; SEQ ID NO: 191; SEQ ID NO: 192; SEQ ID NO: 193; SEQ ID NO: 194; SEQ ID NO: 195; SEQ ID NO: 196; SEQ ID NO: 197; SEQ ID NO: 198; SEQ ID NO: 199; SEQ ID NO: 200; SEQ ID NO: 201; SEQ ID NO: 202; SEQ ID NO: 203; SEQ ID NO: 204; SEQ ID NO: 205; SEQ ID NO: 206; SEQ ID NO: 207; SEQ ID NO: 208; SEQ ID NO: 209; SEQ ID NO: 210; SEQ ID NO: 211; SEQ ID NO: 212; SEQ ID NO: 213; SEQ ID NO: 214; SEQ ID NO: 215; SEQ ID NO: 216; SEQ ID NO: 217; SEQ ID NO: 218; and SEQ ID NO: 219. The nucleotide sequence of the 23S rRNA consensus sequence is SEQ ID NO: 4.

Figures 1, 1A:
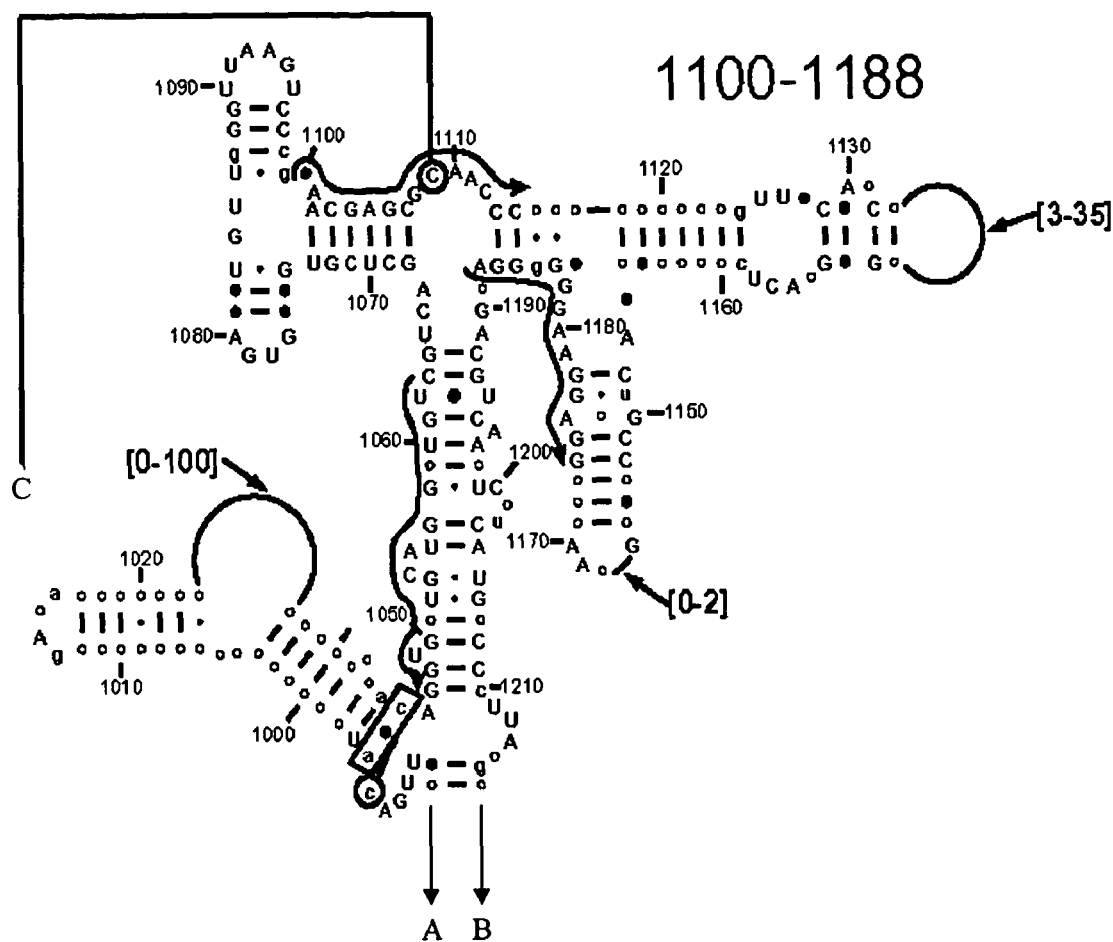
FIGS. 1A-1H and FIG. 2 are consensus diagrams that show examples of conserved regions of 16S rRNA (FIG. 1A, 1A-2, 1A-3, 1A-4 and 1A-5), 23S rRNA (3'-half, FIG. 1B-1, 1B-2, 1C-1, 1C-2, and 1D; 5'-half, FIG. 1E-F), 23S rRNA Domain I (FIG. 1G), 23S rRNA Domain IV (FIG. 1H) and 16S rRNA Domain III (FIG. 2). DNA segments encoding these regions are suitable for use as templates for generation of bioagent identifying amplicons. Lines with arrows are examples of regions (in corresponding DNA) to which intelligent primer pairs for PCR are designed. The label for each primer pair represents the starting and ending base number of the amplified region on the consensus diagram. Bases in capital letters are greater than 95% conserved; bases in lower case letters are 90-95% conserved, filled circles are 80-90% conserved; and open circles are less than 80% conserved. The label for each primer pair represents the starting and ending base number of the amplified region on the consensus diagram. The nucleotide sequences for the 16S rRNA (FIGS. 1A-1 to 1A-5 and 2) are, sequentially from the 5' end to the 3'end, the following: SEQ ID NO: 106; SEQ ID NO: ;107; SEQ ID NO: 108; SEQ ID NO: 109; SEQ ID NO: 110; SEQ ID NO: 111; SEQ ID NO: 112; SEQ ID NO: 113; SEQ ID NO: 114; SEQ ID NO.
Figures 1, 1A, 2:
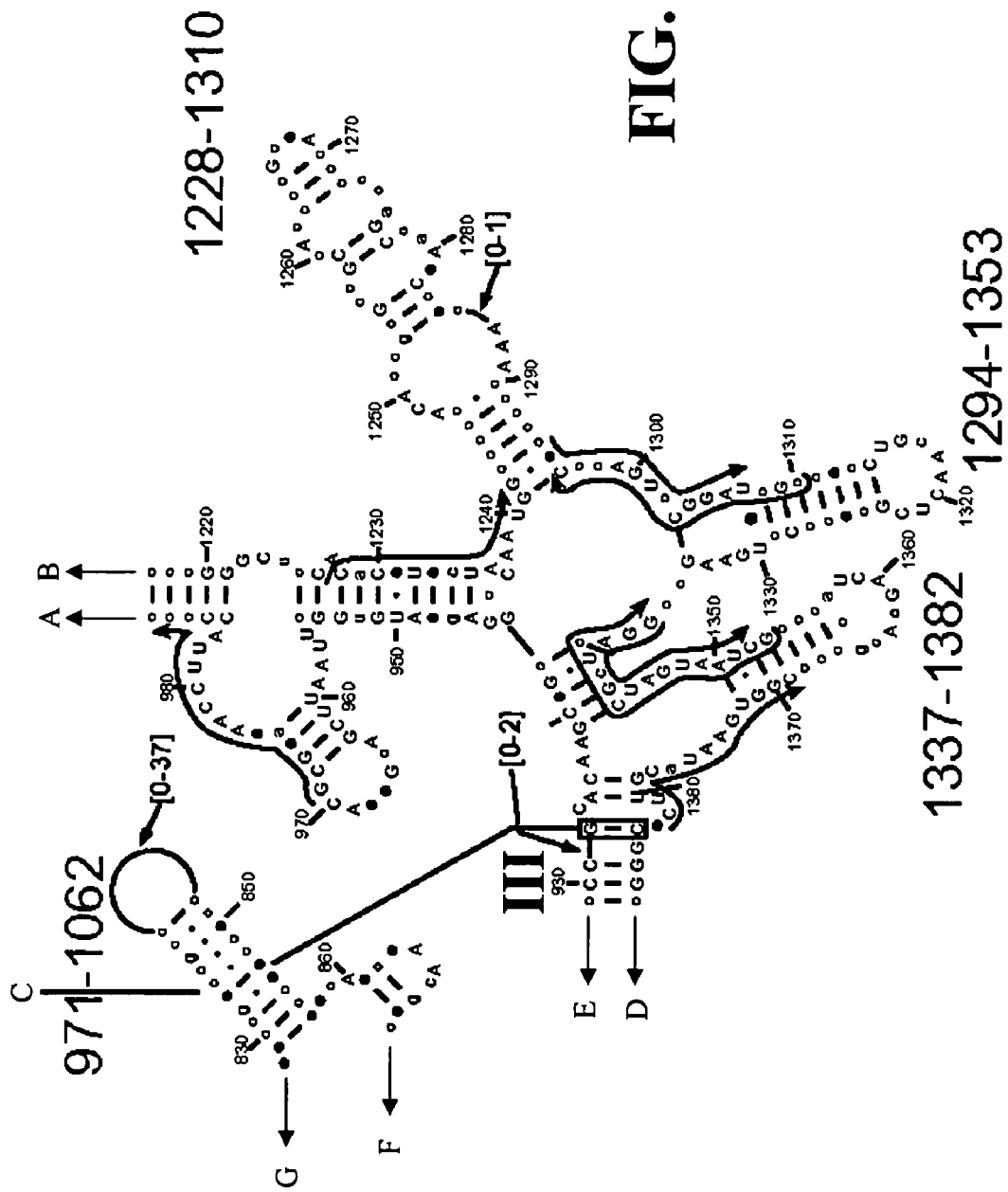

FIG. 2 shows a typical primer amplified region from the 16S rRNA Domain III shown in FIG. 1A-1.

Figures 1, 1A, 2, 3:
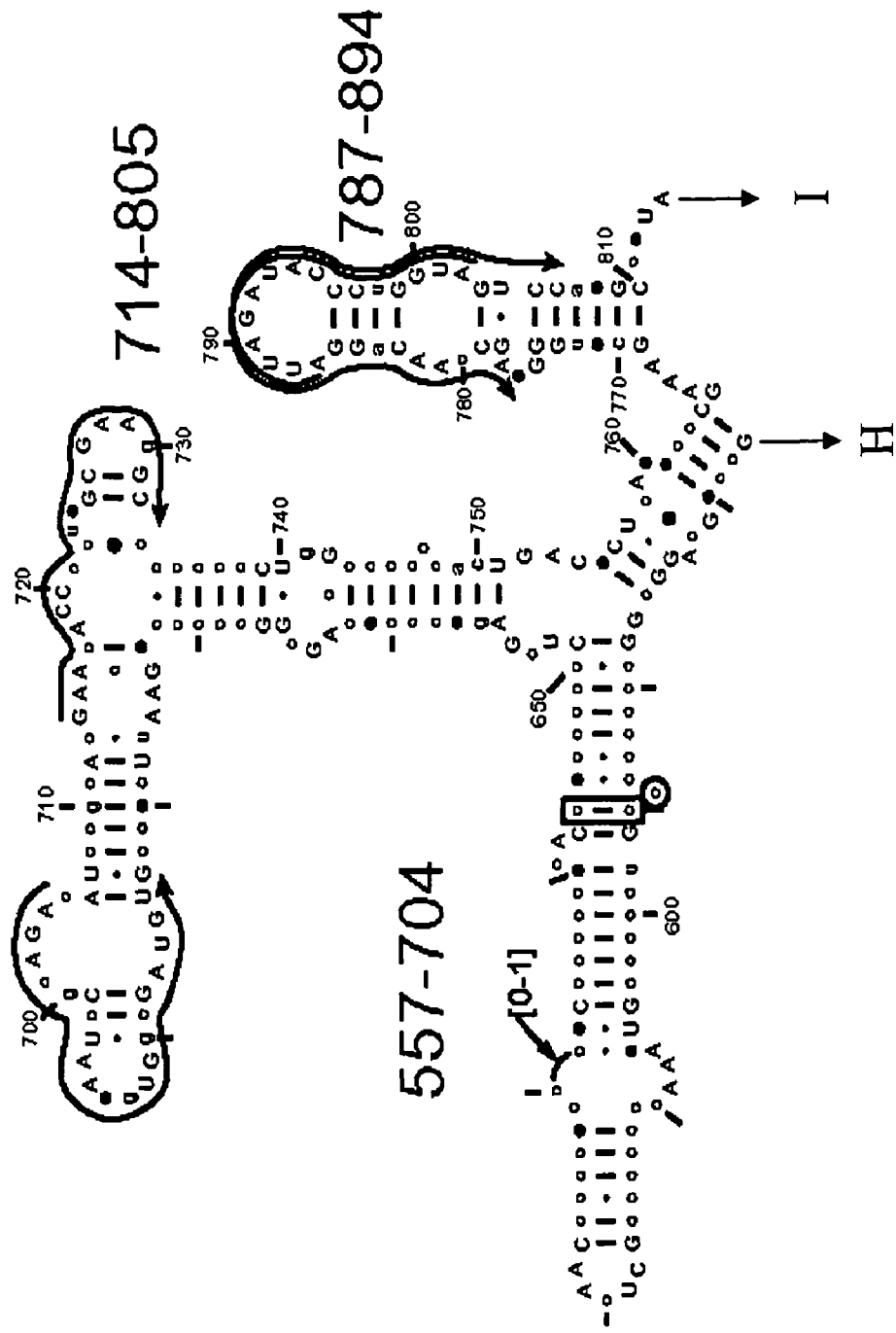

FIG. 3 is a schematic diagram showing conserved regions in RNase P. Bases in capital letters are greater than 90% conserved; bases in lower case letters are 80-90% conserved; filled circles designate bases which are 70-80% conserved; and open circles designate bases that are less than 70% conserved. The nucleotide sequence for RNase P is SEQ ID NO 220.

Figures 1, 1A, 2, 3, 4:
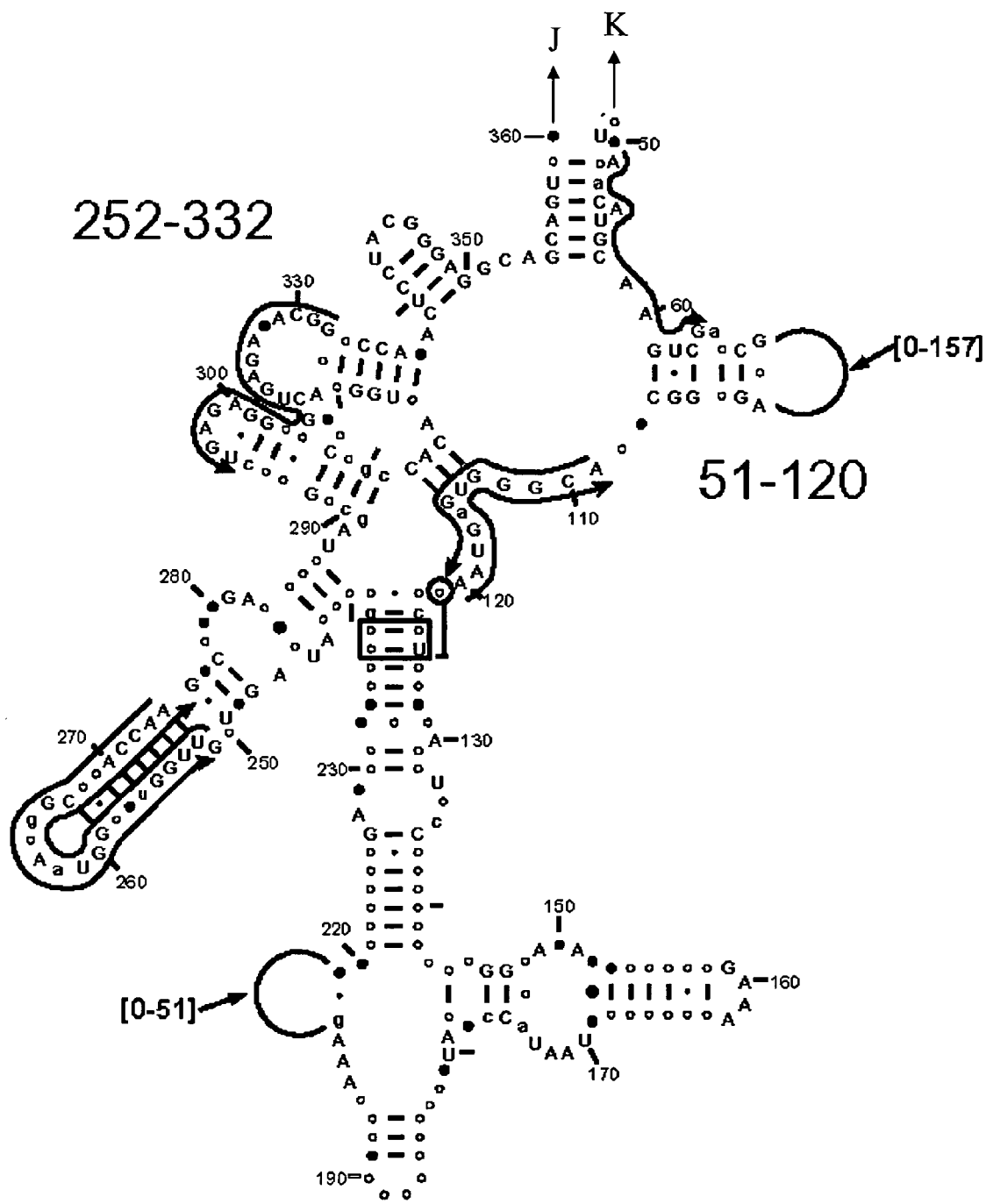

FIG. 4 is a schematic diagram of base composition signature determination using nucleotide analog "tags" to determine base composition signatures. The Watson strand is SEQ ID NO: 221 and the Crick strand is SEQ ID NO: 222.

Figures 1, 1A, 2, 3, 4, 5:
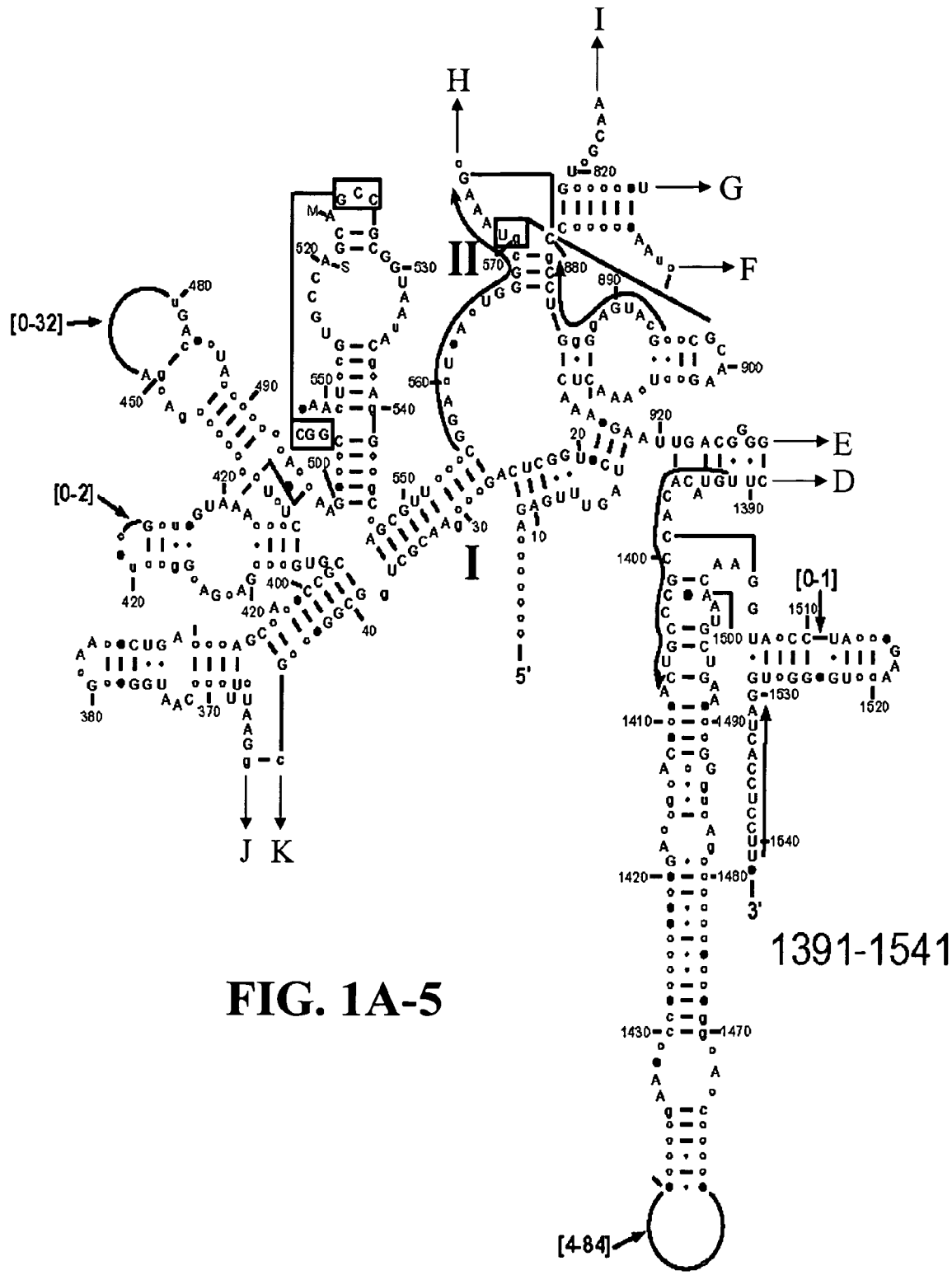
Figure 1B:
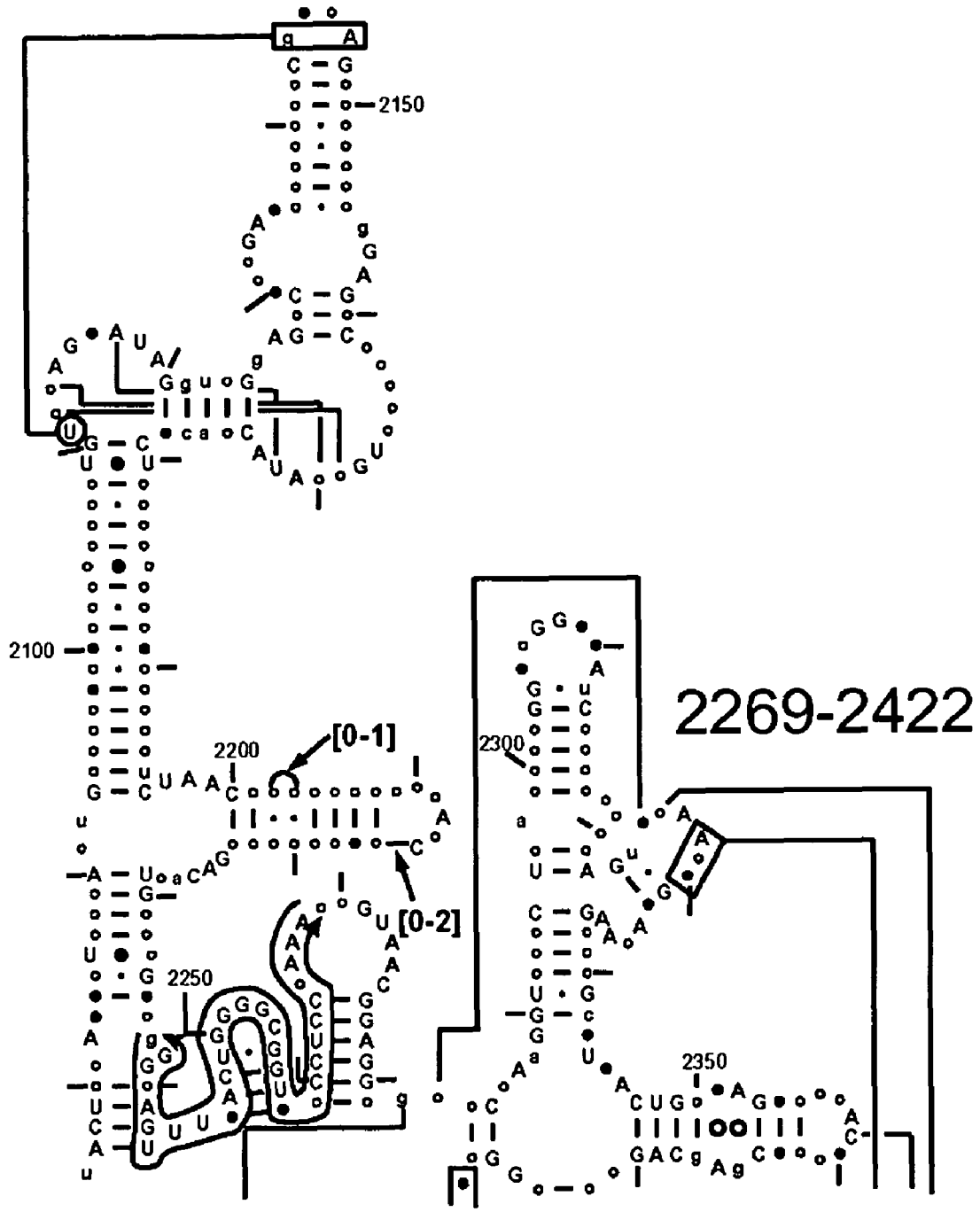
Figure 1C:
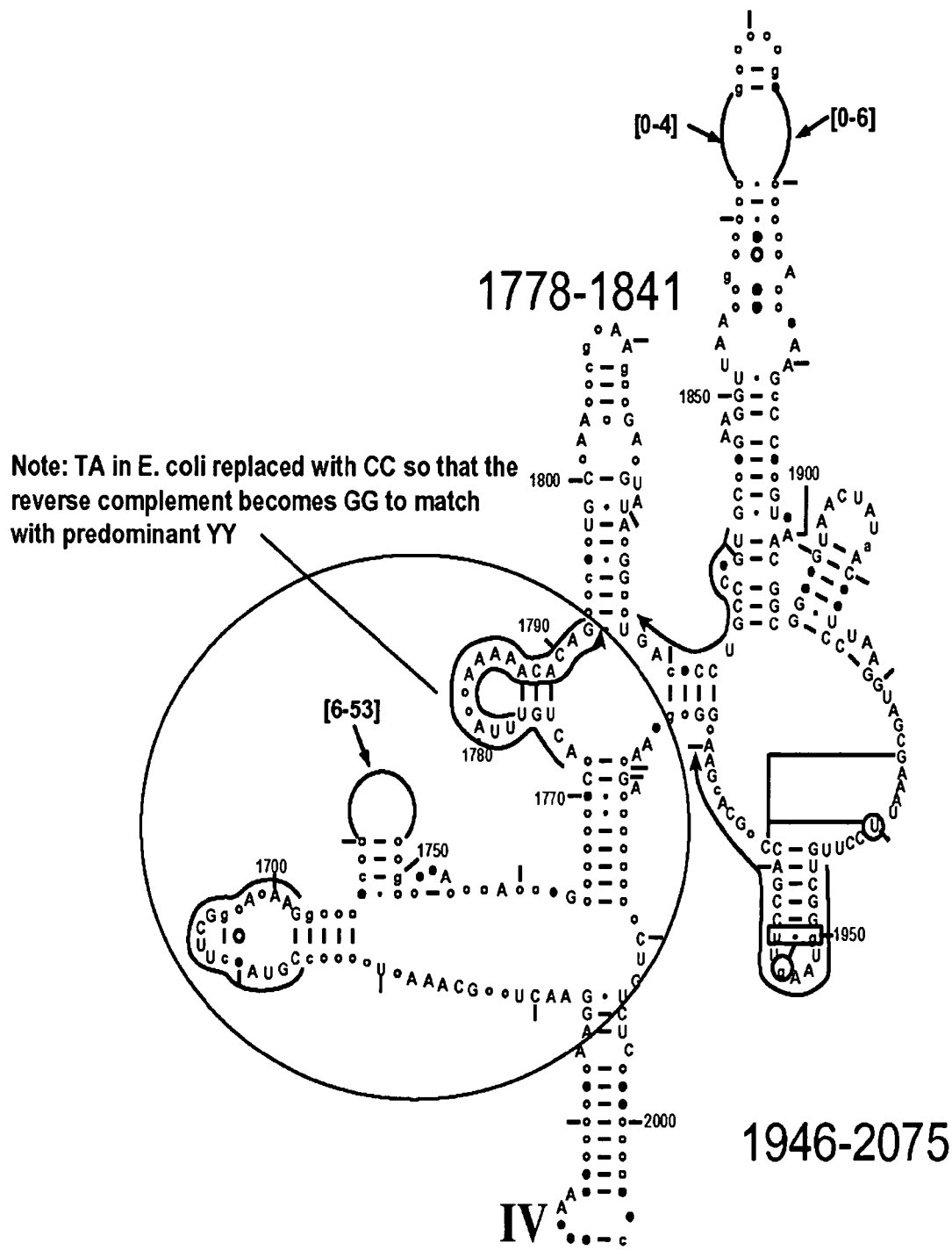
Figure 1D:
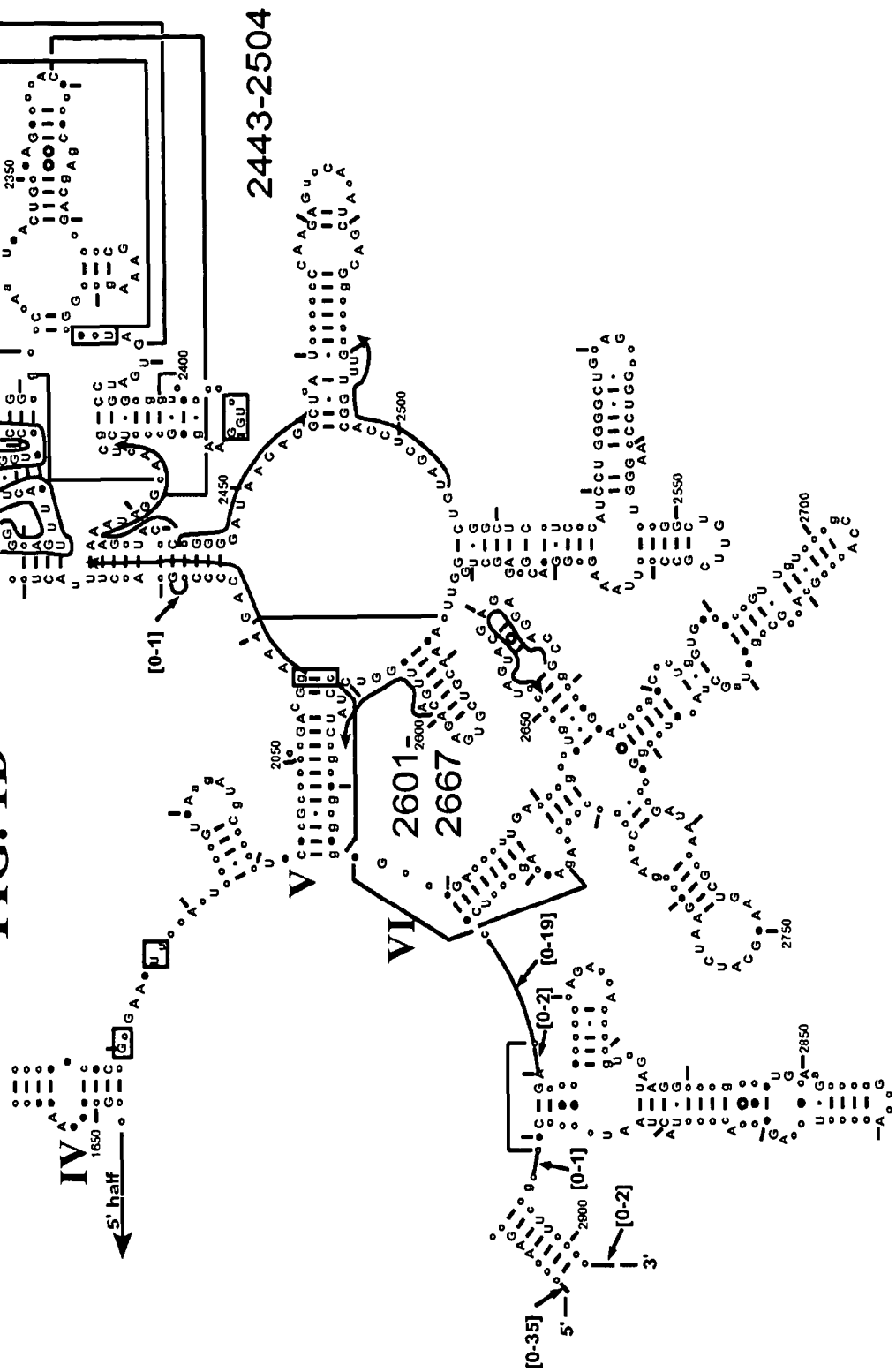
Figure 1E:
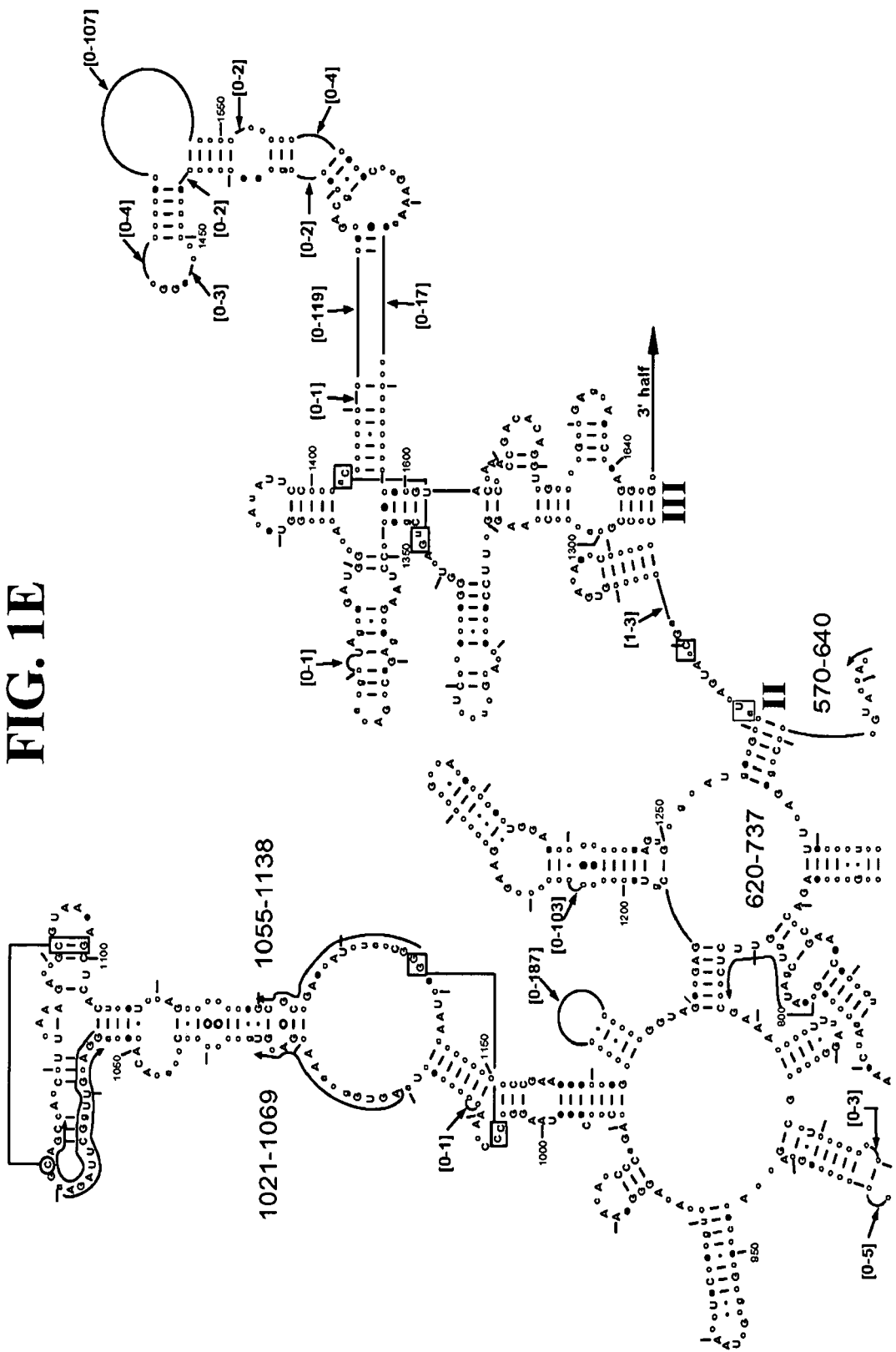
Figure 1F:
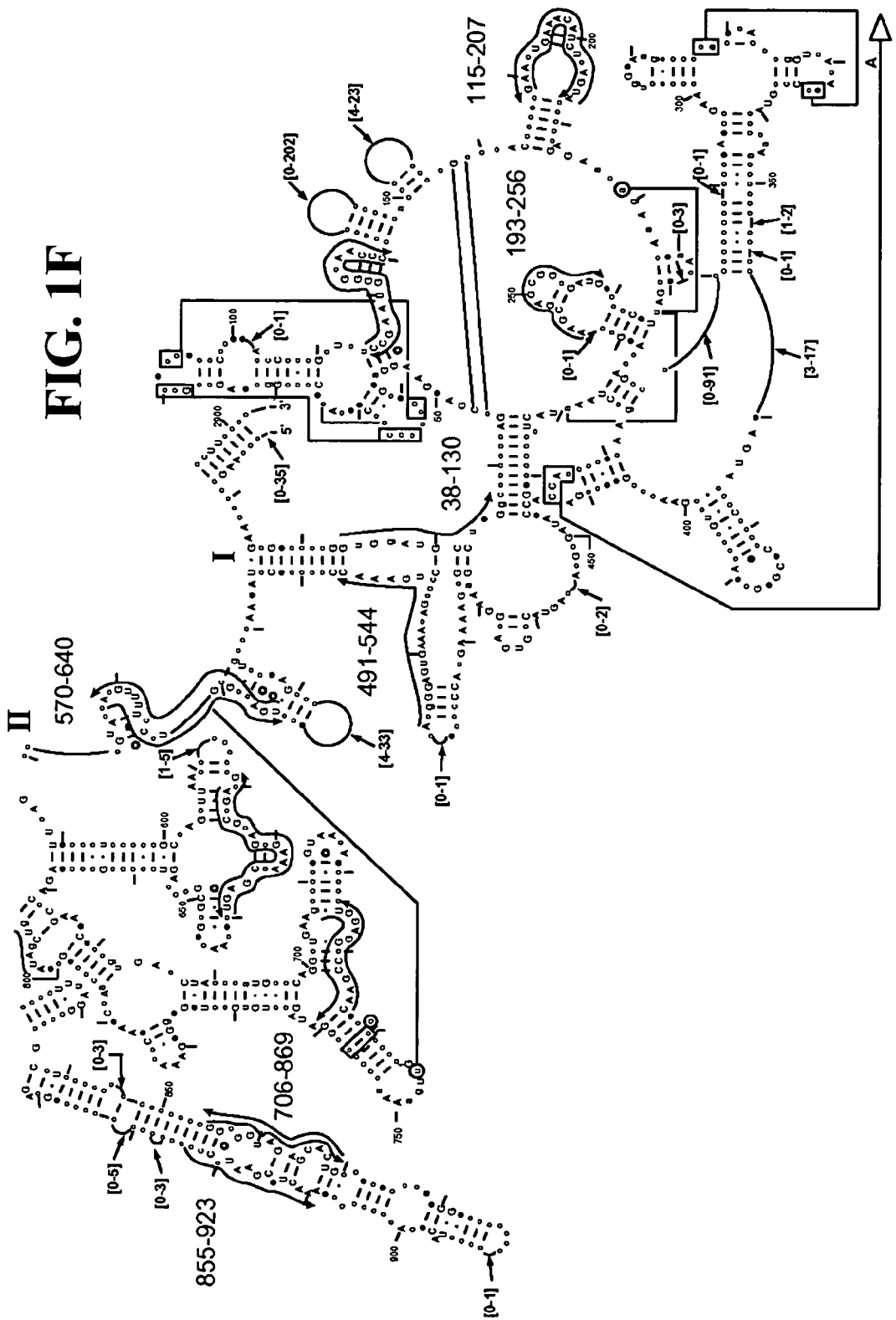
Figure 1G:
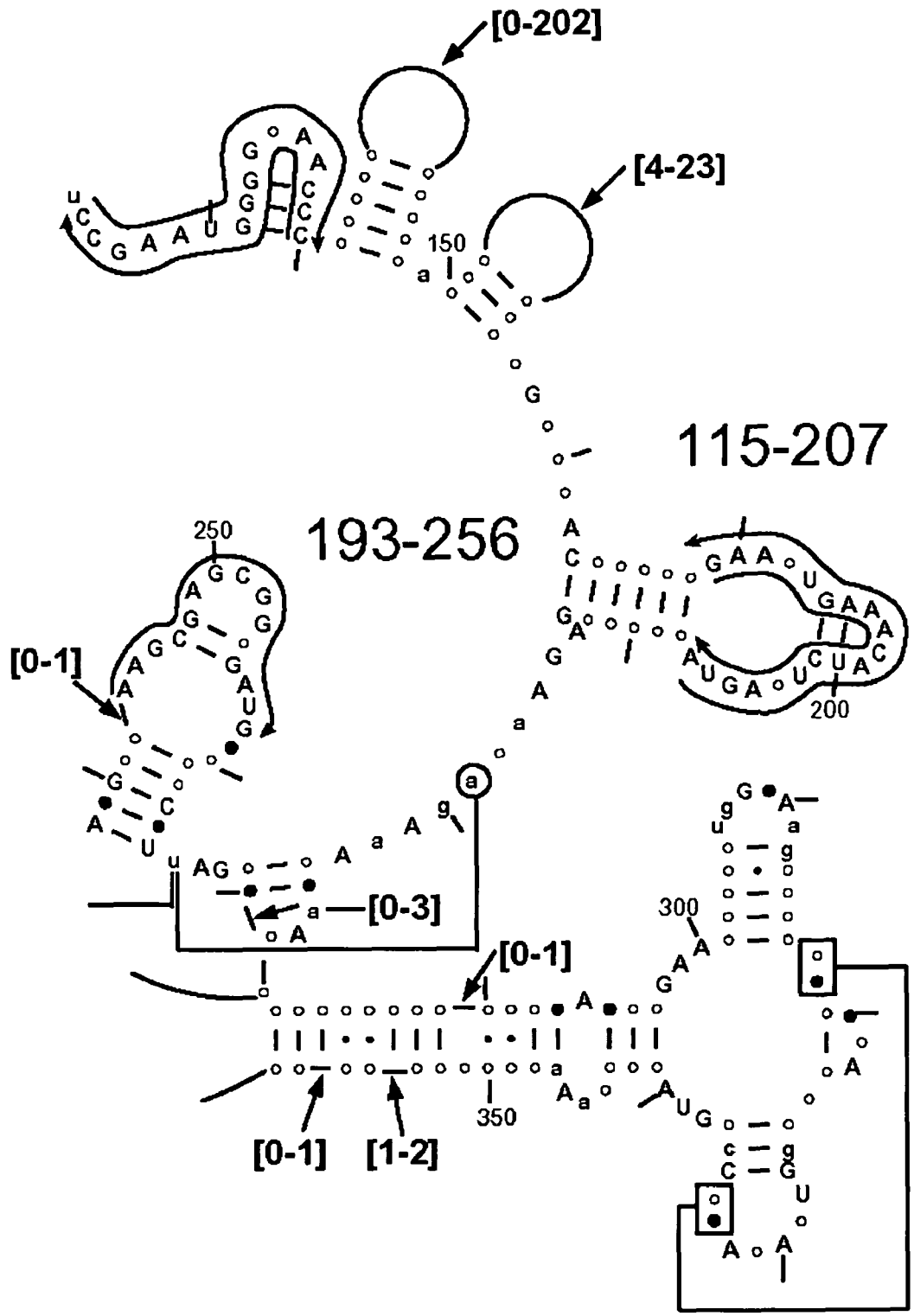
Figure 1H:
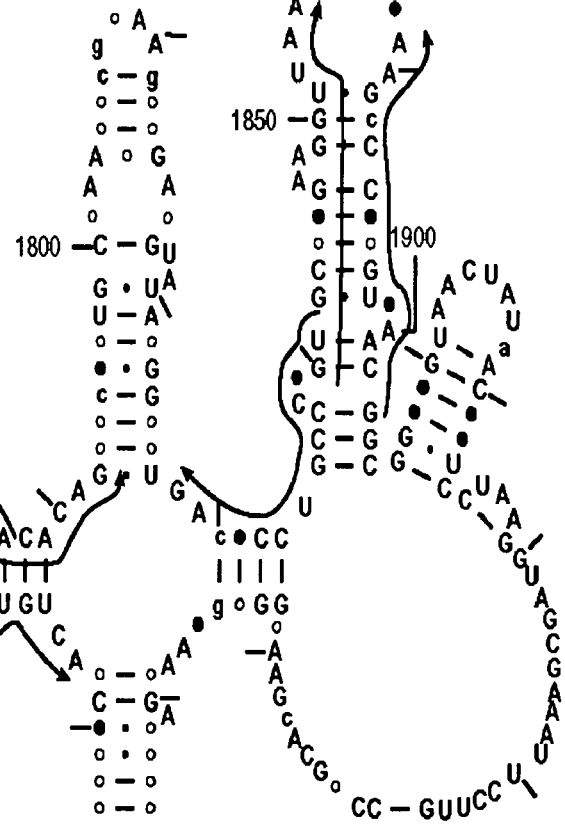
Figure 2:
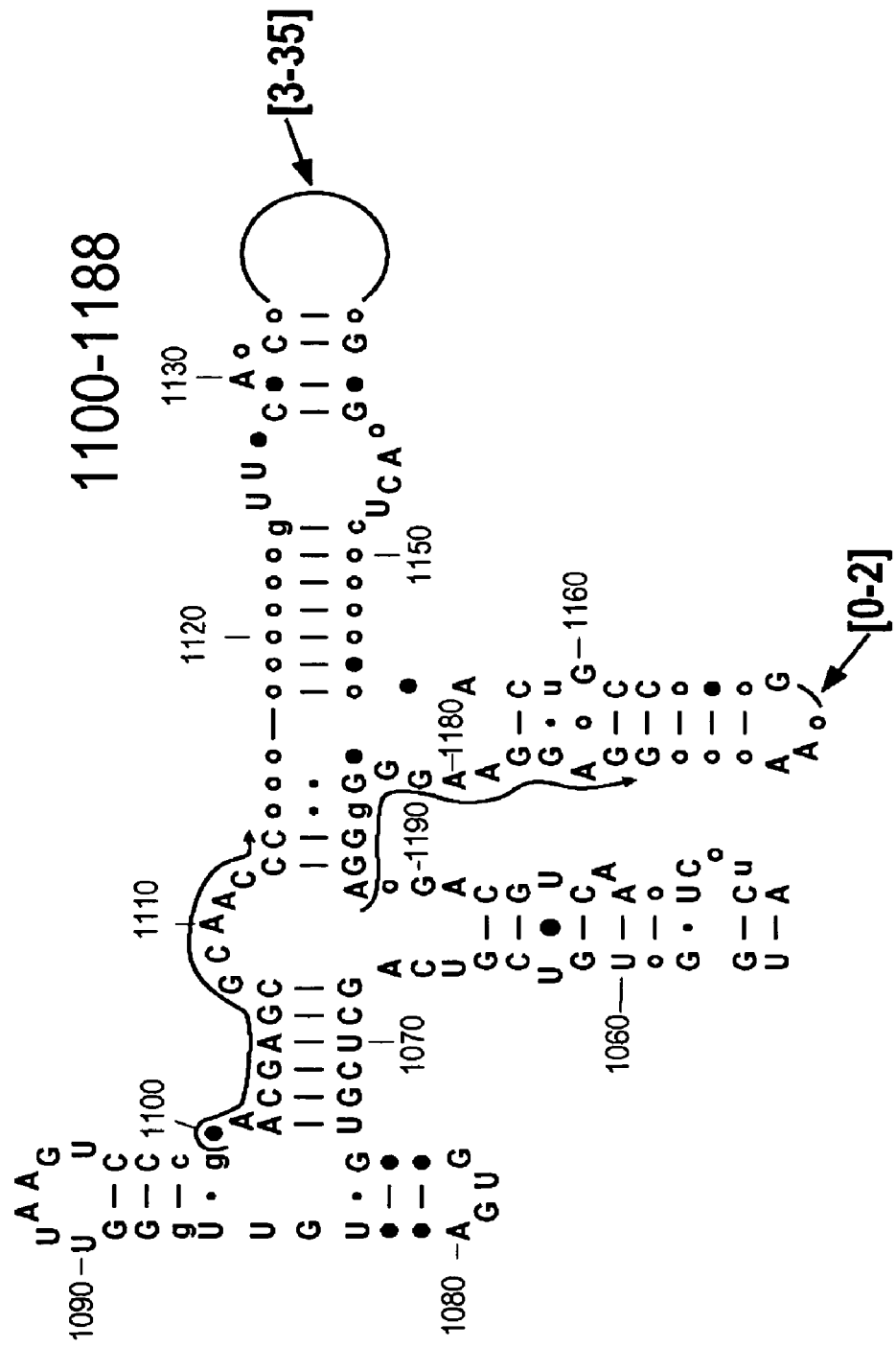
Figure 3:
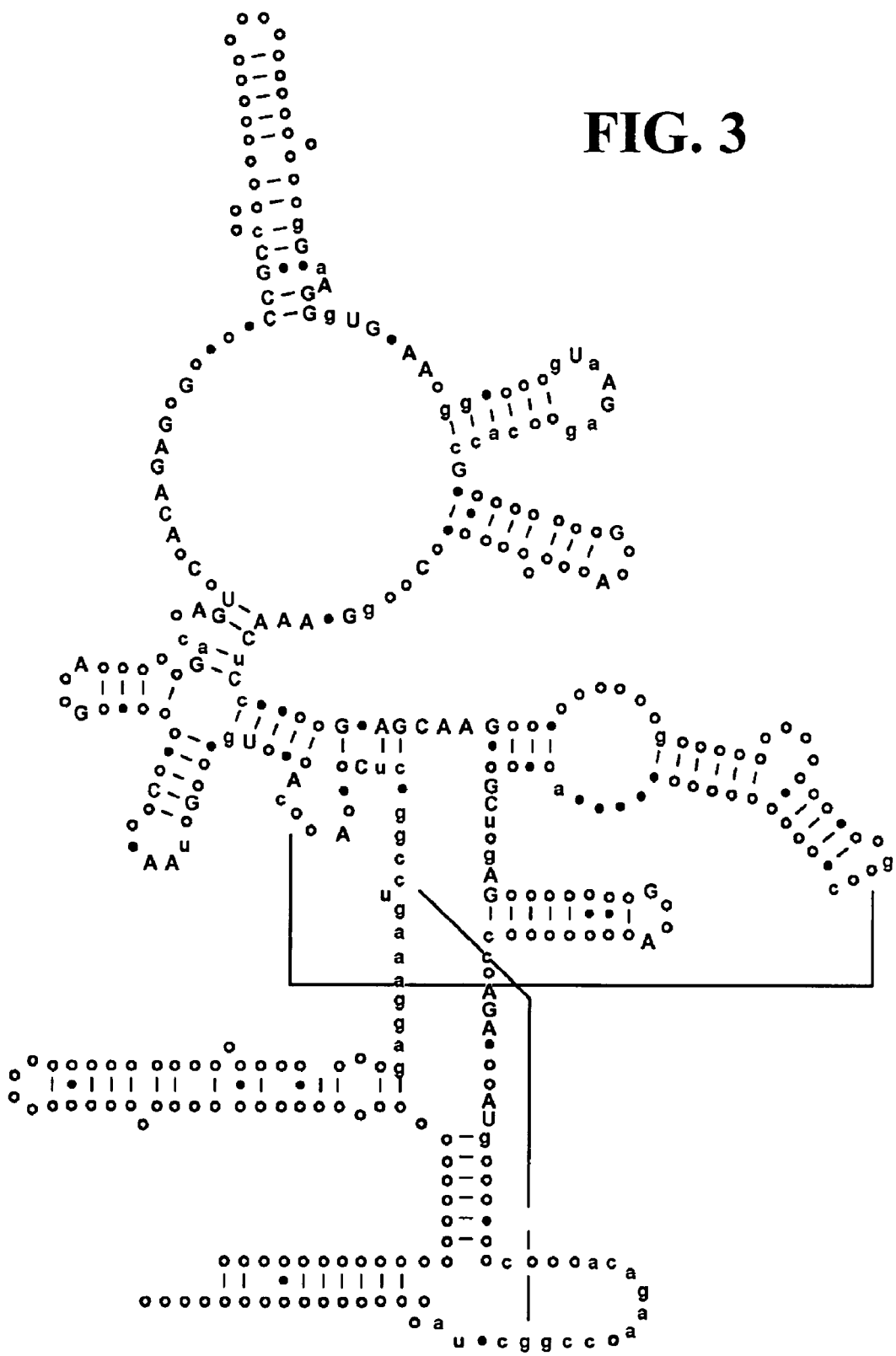
Figure 4:
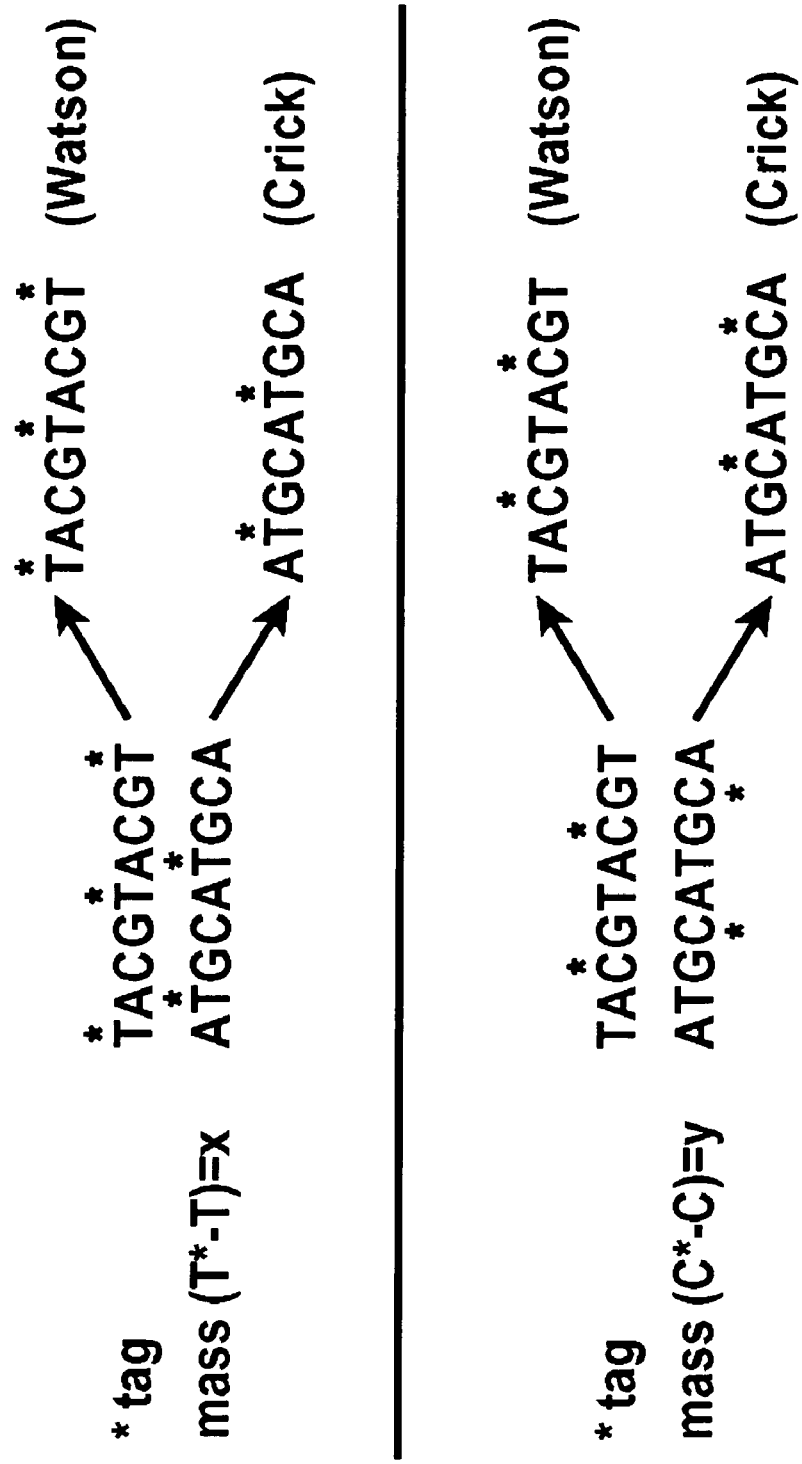

FIG. 5 shows the deconvoluted mass spectra of a *Bacillus anthracis* region with and without the mass tag phosphorothioate A (A*). The two spectra differ in that the measured molecular weight of the mass tag-containing sequence is greater than the unmodified sequence.

FIG. 6 is a process diagram illustrating the primer selection process. For each group of organisms, candidate target sequences are identified (200) from which nucleotide alignments are created (210) and analyzed (220). Primers are then designed by selecting appropriate priming regions (230) which then makes possible the selection of candidate primer pairs (240). The primer pairs are then subjected to in silico analysis by electronic PCR (ePCR) (300) wherein bioagent identifying amplicons are obtained from sequence databases such as GenBank or other sequence collections (310) and checked for specificity in silico (320). Bioagent identifying amplicons obtained from GenBank sequences (310) can also be analyzed by a probability model which predicts the capability of a given amplicon to identify unknown bioagents such that the base compositions of amplicons with favorable probability scores are then stored in a base composition database (325). Alternatively, base compositions of the bioagent identifying amplicons obtained from the primers and GenBank sequences can be directly entered into the base composition database (330). Candidate primer pairs (240) are validated by in vitro amplification by a method such as PCR analysis (400) of nucleic acid from a collection of organisms (410). Amplification products thus obtained are analyzed to confirm the sensitivity, specificity and reproducibility of the primers used to obtain the amplification products (420).

FIG. 7 indicates two coronavirus genomic regions used to generate bioagent identifying amplicons for coronaviruses. The two primer pair regions are mapped onto the SARS CoV (TOR2, NC_004718.3: SEQ ID NO: 85) genome coordinates. The RdRp amplicon corresponds to positions 15,132-15,218 and the nsp11 amplicon corresponds to positions 19,098-19,234 of the same sequence. Multiple sequence alignments of additional available coronavirus sequences corresponding to these two amplified regions are shown. Coronavirus isolates that were sequenced as part of this work are shown with an asterisk. All other sequences were obtained from GenBank. nsp11 sequences for PHEV and TCoV are not available and are shown with a dashed line. Forward and reverse primer regions are highlighted. 5' ends of all primers were designed with a thymidine (T) nucleotide which acts to minimize the addition of non-templated A residues during PCR. For each specific coronavirus, the positions that are mismatched compared to the primer sequence are shown. The complement of the actual primer is shown for the reverse primers. The region between the forward and reverse primers for each virus varies among different coronaviruses (not shown) and provides the signature for resolving them by molecular mass or base composition. Primer positions chemically modified with propyne groups are highlighted. The structures of 5-propynyldeoxycytidine and 5-propynyldeoxyuridine nucleotides used in primers are shown. The RdRp forward primer and the complement of the reverse primer are SEQ ID NOS: 223 and 224. The nsp forward primer and the complement of the reverse primer are SEQ ID NOS: 225 and 226.

FIG. 8 is an ESI-FTICR mass spectrum measurement of the PCR amplicon from the SARS coronavirus obtained using the propynylated RdRp primer pairs. The electrospray ionization conditions separate the sense and antisense strands of the PCR products (500). Multiple charge states are observed across the m/z range shown (510) from which is obtained an expanded view of the isotope envelope of the (M−27H+)27− species (520). The derived molecular masses (530) for the sense amplicon strand is 27298.518 from which is calculated (540) the unambiguous base composition of $A_{27}G_{19}C_{14}T_{28}$ for the sense strand (seen also in Table 4). This base composition corresponds to the base composition calculated based on the bioagent identifying amplicon of the genomic sequence of the SARS coronavirus.

FIG. 9 shows a series of mass spectra which was used to identify three human coronaviruses in a mixture. The deconvoluted (neutral mass) mass spectra obtained for the RdRp primer for the three human coronaviruses, HCoV-229E, HCoV-OC43 and SARS CoV, that were tested individually and in a mixture are shown. Forward and reverse amplicons are shown with the measured monoisotopic masses for each strand.

FIG. 10 indicates three dimensional plots of experimentally determined base compositions (solid cones) and calculated base compositions (spheres) for bioagent identifying amplicons of coronaviruses obtained with a RdRp primer set and a nsp11 primer set. The position of the base composition indicates the intersection of A, C and T content in each base composition, with G content illustrated in a "pseudo-fourth" dimension indicated by the angle of rotation of the cone. For the RdRp primer set, the experimentally-determined base compositions were in agreement with the calculated base compositions except for the canine coronavirus isolate (CcoV) which was found to have a composition that differed from that calculated based on available sequence information by a single T to C substitution (indicated by a dashed line).

FIG. 11 shows a mass spectrum containing mass peaks corresponding to the PCR internal standard calibrant amplicon at a dilution corresponding to a nucleic acid copy number of $3\times10^4$ and a SARS coronavirus bioagent identifying amplicon. The comparison of peak abundances of the two peaks enabled the determination that 1 PFU of SARS coronavirus=300 copies of nucleic acid.

DESCRIPTION OF EMBODIMENTS

A. Introduction

The present invention provides methods for detection and identification of bioagents in an unbiased manner using "bioagent identifying amplicons." "Intelligent primers" are selected to hybridize to conserved sequence regions of nucleic acids derived from a bioagent and which bracket variable sequence regions to yield a bioagent identifying amplicon which can be amplified and which is amenable to molecular mass determination. The molecular mass then provides a means to uniquely identify the bioagent without a requirement for prior knowledge of the possible identity of the bioagent. The molecular mass or corresponding "base composition signature" (BCS) of the amplification product is then matched against a database of molecular masses or base composition signatures. Furthermore, the method can be applied to rapid parallel "multiplex" analyses, the results of which can be employed in a triangulation identification strategy. The present method provides rapid throughput and does not require nucleic acid sequencing of the amplified target sequence for bioagent detection and identification.

B. Bioagents

In the context of this invention, a "bioagent" is any organism, cell, or virus, living or dead, or a nucleic acid derived from such an organism, cell or virus. Examples of bioagents include, but are not limited, to cells, including but not limited to human clinical samples, bacterial cells and other pathogens), viruses, fungi, protists, parasites, and pathogenicity markers (including but not limited to: pathogenicity islands, antibiotic resistance genes, virulence factors, toxin genes and other bioregulating compounds). Samples may be alive or dead or in a vegetative state (for example, vegetative bacteria or spores) and may be encapsulated or bioengineered. In the context of this invention, a "pathogen" is a bioagent which causes a disease or disorder.

Despite enormous biological diversity, all forms of life on earth share sets of essential, common features in their genomes. Bacteria, for example have highly conserved sequences in a variety of locations on their genomes. Most notable is the universally conserved region of the ribosome. There are also conserved elements in other non-coding RNAs, including RNAse P (FIG. 3) and the signal recognition particle (SRP) among others. Bacteria have a common set of absolutely required genes. About 250 genes are present in all bacterial species (*Proc. Natl. Acad. Sci. U.S.A.,* 1996, 93, 10268; *Science,* 1995, 270, 397), including tiny genomes like *Mycoplasma, Ureaplasma* and *Rickettsia*. These genes encode proteins involved in translation, replication, recombination and repair, transcription, nucleotide metabolism, amino acid metabolism, lipid metabolism, energy generation, uptake, secretion and the like. Examples of these proteins are DNA polymerase III beta, elongation factor TU, heat shock protein groEL, RNA polymerase beta, phosphoglycerate kinase, NADH dehydrogenase, DNA ligase, DNA topoisomerase and elongation factor G. Operons can also be targeted using the present method. One example of an operon is the bfp operon from enteropathogenic *E. coli*. Multiple core chromosomal genes can be used to classify bacteria at a genus or genus species level to determine if an organism has threat potential. The methods can also be used to detect pathogenicity markers (plasmid or chromosomal) and antibiotic resistance genes to confirm the threat potential of an organism and to direct countermeasures.

C. Selection of "Bioagent Identifying Amplicons"

Since genetic data provide the underlying basis for identification of bioagents by the methods of the present invention, it is necessary to select segments of nucleic acids which ideally provide enough variability to distinguish each individual bioagent and whose molecular mass is amenable to molecular mass determination. In one embodiment of the present invention, at least one polynucleotide segment is amplified to facilitate detection and analysis in the process of identifying the bioagent. Thus, the nucleic acid segments which provide enough variability to distinguish each individual bioagent and whose molecular masses are amenable to molecular mass determination are herein described as "bioagent identifying amplicons." The term "amplicon" as used herein, refers to a segment of a polynucleotide which is amplified in an amplification reaction.

In one embodiment, bioagent identifying amplicons are from about 45 nucleobases to about 150 nucleobases in length.

Pre-bioagent identifying amplicons are amplicons which may greatly exceed about 45 to about 150 nucleobases in length and which contain sites for cleavage (by restriction endonucleases, for example) to yield bioagent identifying amplicons which are fragments of a given pre-bioagent identifying amplicon and which are amenable to molecular mass analysis.

As used herein, "intelligent primers" are primers that are designed to bind to highly conserved sequence regions of a bioagent identifying amplicon that flank an intervening variable region and yield amplification products which ideally provide enough variability to distinguish each individual bioagent, and which are amenable to molecular mass analysis. By the term "highly conserved," it is meant that the sequence regions exhibit between about 80-100%, or between about 90-100%, or between about 95-100% identity. The molecular mass of a given amplification product provides a means of identifying the bioagent from which it was obtained, due to the variability of the variable region. Thus design of intelligent primers requires selection of a variable region with appropriate variability to resolve the identity of a given bioagent. Bioagent identifying amplicons are ideally specific to the identity of the bioagent. A plurality of bioagent identifying amplicons selected in parallel for distinct bioagents which contain the same conserved sequences for hybridization of the same pair of intelligent primers are herein defined as "correlative bioagent identifying amplicons."

In one embodiment, the bioagent identifying amplicon is a portion of a ribosomal RNA (rRNA) gene sequence. With the complete sequences of many of the smallest microbial genomes now available, it is possible to identify a set of genes that defines "minimal life" and identify composition signatures that uniquely identify each gene and organism. Genes that encode core life functions such as DNA replication, transcription, ribosome structure, translation, and transport are distributed broadly in the bacterial genome and are suitable regions for selection of bioagent identifying amplicons. Ribosomal RNA (rRNA) genes comprise regions that provide useful base composition signatures. Like many genes involved in core life functions, rRNA genes contain sequences that are extraordinarily conserved across bacterial domains interspersed with regions of high variability that are more specific to each species. The variable regions can be utilized to build a database of base composition signatures. The strategy involves creating a structure-based alignment of sequences of the small (16S) and the large (23S) subunits of the rRNA genes. For example, there are currently over 13,000 sequences in the ribosomal RNA database that has been created and maintained by Robin Gutell, University of Texas at Austin, and is publicly available on the Institute for Cellular and Molecular Biology at the RNA ICMB site at the University of Texas. There is also a publicly available database at the rRNA site of the University of Antwerp created and maintained by the University of Antwerp, Belgium.

These databases have been analyzed to determine regions that are useful as bioagent identifying amplicons. The characteristics of such regions include: a) between about 80 and 100%, or greater than about 95% identity among species of the particular bioagent of interest, of upstream and downstream nucleotide sequences which serve as sequence amplification primer sites; b) an intervening variable region which exhibits no greater than about 5% identity among species; and c) a separation of between about 30 and 1000 nucleotides, or no more than about 50-250 nucleotides, or no more than about 60-100 nucleotides, between the conserved regions.

As a non-limiting example, for identification of *Bacillus* species, the conserved sequence regions of the chosen bioagent identifying amplicon must be highly conserved among all *Bacillus* species while the variable region of the bioagent identifying amplicon is sufficiently variable such that the molecular masses of the amplification products of all species of *Bacillus* are distinguishable.

Bioagent identifying amplicons amenable to molecular mass determination are either of a length, size or mass compatible with the particular mode of molecular mass determination or compatible with a means of providing a predictable fragmentation pattern in order to obtain predictable fragments of a length compatible with the particular mode of molecular mass determination. Such means of providing a predictable fragmentation pattern of an amplification product include, but are not limited to, cleavage with restriction enzymes or cleavage primers, for example.

Identification of bioagents can be accomplished at different levels using intelligent primers suited to resolution of each individual level of identification. "Broad range survey" intelligent primers are designed with the objective of identifying a bioagent as a member of a particular division of bioagents. A "bioagent division" is defined as group of bioagents above the species level and includes but is not limited to: orders, families, classes, clades, genera or other such groupings of bioagents above the species level. As a non-limiting example, members of the *Bacillus/Clostridia* group or gamma-proteobacteria group may be identified as such by employing broad range survey intelligent primers such as primers which target 16S or 23S ribosomal RNA.

In some embodiments, broad range survey intelligent primers are capable of identification of bioagents at the species level. One main advantage of the detection methods of the present invention is that the broad range survey intelligent primers need not be specific for a particular bacterial species, or even genus, such as *Bacillus* or *Streptomyces*. Instead, the primers recognize highly conserved regions across hundreds of bacterial species including, but not limited to, the species described herein. Thus, the same broad range survey intelligent primer pair can be used to identify any desired bacterium because it will bind to the conserved regions that flank a variable region specific to a single species, or common to several bacterial species, allowing unbiased nucleic acid amplification of the intervening sequence and determination of its molecular weight and base composition. For example, the 16S_971-1062, 16S_1228-1310 and 16S_1100-1188 regions are 98-99% conserved in about 900 species of bacteria (16S=16S rRNA, numbers indicate nucleotide position). In one embodiment of the present invention, primers used in the present method bind to one or more of these regions or portions thereof.

Due to their overall conservation, the flanking rRNA primer sequences serve as good intelligent primer binding sites to amplify the nucleic acid region of interest for most, if not all, bacterial species. The intervening region between the sets of primers varies in length and/or composition, and thus provides a unique base composition signature. Examples of intelligent primers that amplify regions of the 16S and 23S rRNA are shown in FIGS. 1A-1H. A typical primer amplified region in 16S rRNA is shown in FIG. 2. The arrows represent primers that bind to highly conserved regions of the DNA encoding these regions, which flank a variable region in 16S rRNA domain III. The amplified region corresponds to the stem-loop structure under "1100-1188." It is advantageous to design the broad range survey intelligent primers to minimize the number of primers required for the analysis, and to allow detection of multiple members of a bioagent division using a single pair of primers. The advantage of using broad range survey intelligent primers is that once a bioagent is broadly identified, the process of further identification at species and sub-species levels is facilitated by directing the choice of additional intelligent primers.

"Division-wide" intelligent primers are designed with an objective of identifying a bioagent at the species level. As a non-limiting example, a *Bacillus anthracis, Bacillus cereus* and *Bacillus thuringiensis* can be distinguished from each other using division-wide intelligent primers. Division-wide intelligent primers are not always required for identification at the species level because broad range survey intelligent primers may provide sufficient identification resolution to accomplishing this identification objective.

"Drill-down" intelligent primers are designed with an objective of identifying a sub-species characteristic of a bioagent. A "sub-species characteristic" is defined as a property imparted to a bioagent at the sub-species level of identification as a result of the presence or absence of a particular segment of nucleic acid. Such sub-species characteristics include, but are not limited to, strains, sub-types, pathogenicity markers such as antibiotic resistance genes, pathogenicity islands, toxin genes and virulence factors. Identification of such sub-species characteristics is often critical for determining proper clinical treatment of pathogen infections.

D. Selection and Optimization of Intelligent Primers

Figure 6:
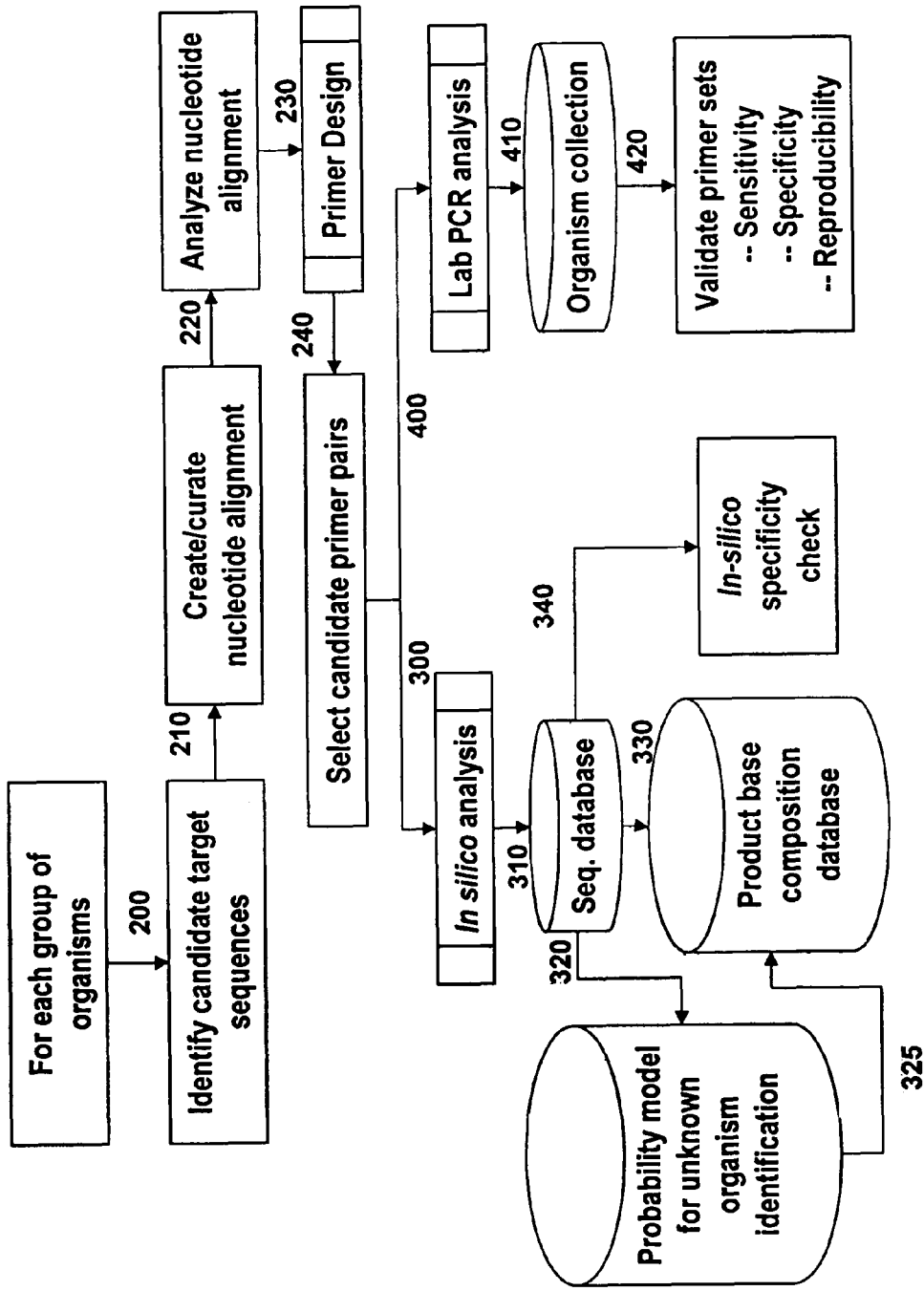
Figure 7:
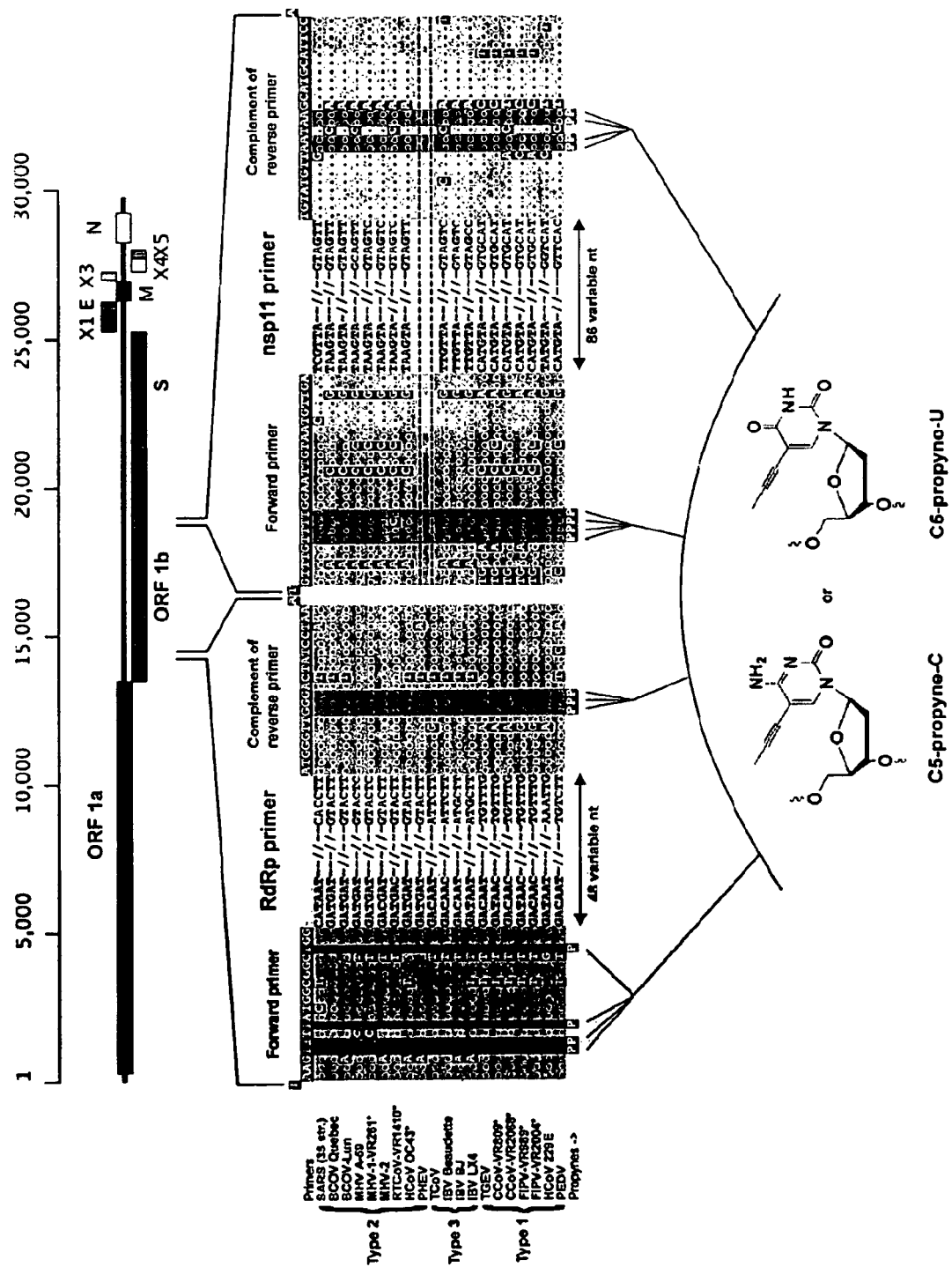

A representative process flow diagram used for primer selection and validation process is outlined in FIG. 6. Many of the important pathogens, including the organisms of greatest concern as biological weapons agents, have been completely sequenced. This effort has greatly facilitated the design of primers and probes for the detection of bacteria. Partial or full-length sequences from over 225 bacterial genomes have been obtained and sequence alignments have been generated for essential genes that are conserved either broadly across all organisms or within members of specific, related phylogenetic groups. In bacteria, for instance, alignments have been generated from over 170 housekeeping genes that are present in almost all major bacterial divisions. These genes have been used for identification of broad diagnostic primers. PCR primer selection and optimization has been largely automated. A number of genes, in addition to 16S rRNA, are targets of "broad-range" primers, thus increasing the redundancy of detection and classification, while minimizing potential missed identifications. Many of these genes are, expectedly, essential to information processing, with more than half being associated with the translational machinery, such as elongation factors, ribosomal proteins and tRNA synthetases. Other classes of conserved protein-encoding genes include transcription-associated genes such as RNA polymerases and genes associated with DNA replication such as DNA gyrase and DNA polymerase. This combination of broad-range priming with clade-and species-specific priming has been used very successfully in several applications of the technology, including environmental surveillance for biowarfare threat agents and clinical sample analysis for medically important pathogens.

Ideally, intelligent primer hybridization sites are highly conserved in order to facilitate the hybridization of the primer. In cases where primer hybridization is less efficient due to lower levels of conservation of sequence, intelligent primers can be chemically modified to improve the efficiency of hybridization.

In some embodiments of the present invention, intelligent primers may contain one or more universal bases. Because any variation (due to codon wobble in the $3^{rd}$ position) in the conserved regions among species is likely to occur in the third position of a DNA triplet, oligonucleotide primers can be designed such that the nucleotide corresponding to this position is a base which can bind to more than one nucleotide, referred to herein as a "universal nucleobase." For example, under this "wobble" pairing, inosine (I) binds to U, C or A; guanine (G) binds to U or C, and uridine (U) binds to U or C. Other examples of universal nucleobases include nitroindoles such as 5-nitroindole or 3-nitropyrrole (Loakes et al., *Nucleosides and Nucleotides*, 1995, 14, 1001-1003), the degenerate nucleotides dP or dK (Hill et al.), an acyclic nucleoside analog containing 5-nitroindazole (Van Aerschot et al., *Nucleosides and Nucleotides*, 1995, 14, 1053-1056) or the purine analog 1-(2-deoxy-β-D-ribofuranosyl)-imidazole-4-carboxamide (Sala et al., *Nucl. Acids Res.*, 1996, 24, 3302-3306).

In another embodiment of the invention, to compensate for the somewhat weaker binding by the "wobble" base, the oligonucleotide primers are designed such that the first and second positions of each triplet are occupied by nucleotide analogs which bind with greater affinity than the unmodified nucleotide. Examples of these analogs include, but are not limited to, 2,6-diaminopurine which binds to thymine, 5-propynyluracil which binds to adenine and 5-propynylcytosine and phenoxazines, including G-clamp, which binds to G. Propynylated pyrimidines are described in U.S. Pat. Nos. 5,645,985, 5,830,653 and 5,484,908, each of which is commonly owned and incorporated herein by reference in its entirety. Propynylated primers are claimed in U.S. Ser. No. 10/294,203 which is also commonly owned and incorporated herein by reference in entirety. Phenoxazines are described in U.S. Pat. Nos. 5,502,177, 5,763,588, and 6,005,096, each of which is incorporated herein by reference in its entirety. G-clamps are described in U.S. Pat. Nos. 6,007,992 and 6,028,183, each of which is incorporated herein by reference in its entirety.

In other embodiments, non-template primer tags are used to increase the melting temperature ($T_m$) of a primer-template duplex in order to improve amplification efficiency. A non-template tag is designed to hybridize to at least three consecutive A or T nucleotide residues on a primer which are complementary to the template. In any given non-template tag, A can be replaced by C or G and T can also be replaced by C or G. The extra hydrogen bond in a G-C pair relative to a A-T pair confers increased stability of the primer-template duplex and improves amplification efficiency.

In other embodiments, propynylated tags may be used in a manner similar to that of the non-template tag, wherein two or more 5-propynylcytidine or 5-propynyluridine residues replace template matching residues on a primer.

In other embodiments, a primer contains a modified internucleoside linkage such as a phosphorothioate linkage, for example.

E. Characterization of Bioagent Identifying Amplicons

A theoretically ideal bioagent detector would identify, quantify, and report the complete nucleic acid sequence of every bioagent that reached the sensor. The complete sequence of the nucleic acid component of a pathogen would provide all relevant information about the threat, including its identity and the presence of drug-resistance or pathogenicity markers. This ideal has not yet been achieved. However, the present invention provides a straightforward strategy for obtaining information with the same practical value based on analysis of bioagent identifying amplicons by molecular mass determination.

In some cases, a molecular mass of a given bioagent identifying amplicon alone does not provide enough resolution to unambiguously identify a given bioagent. For example, the molecular mass of the bioagent identifying amplicon obtained using the intelligent primer pair "16S_971" would be 55622 Da for both *E. coli* and *Salmonella typhimurium*. However, if additional intelligent primers are employed to analyze additional bioagent identifying amplicons, a "triangulation identification" process is enabled. For example, the "16S_1100" intelligent primer pair yields molecular masses of 55009 and 55005 Da for *E. coli* and *Salmonella typhimurium*, respectively. Furthermore, the "23S_855" intelligent primer pair yields molecular masses of 42656 and 42698 Da for *E. coli* and *Salmonella typhimurium*, respectively. In this basic example, the second and third intelligent primer pairs provided the additional "fingerprinting" capability or resolution to distinguish between the two bioagents.

In another embodiment, the triangulation identification process is pursued by measuring signals from a plurality of bioagent identifying amplicons selected within multiple core genes. This process is used to reduce false negative and false positive signals, and enable reconstruction of the origin of hybrid or otherwise engineered bioagents. In this process, after identification of multiple core genes, alignments are created from nucleic acid sequence databases. The alignments are then analyzed for regions of conservation and variation, and bioagent identifying amplicons are selected to distinguish bioagents based on specific genomic differences. For example, identification of the three part toxin genes typical of *B. anthracis* (Bowen et al., *J. Appl. Microbiol.*, 1999, 87, 270-278) in the absence of the expected signatures from the *B. anthracis* genome would suggest a genetic engineering event.

The triangulation identification process can be pursued by characterization of bioagent identifying amplicons in a massively parallel fashion using the polymerase chain reaction (PCR), such as multiplex PCR, and mass spectrometric (MS) methods. Sufficient quantities of nucleic acids should be present for detection of bioagents by MS. A wide variety of techniques for preparing large amounts of purified nucleic acids or fragments thereof are well known to those of ordinary skill in the art. PCR requires one or more pairs of oligonucleotide primers that bind to regions which flank the target sequence(s) to be amplified. These primers prime synthesis of a different strand of DNA, with synthesis occurring in the direction of one primer towards the other primer. The primers, DNA to be amplified, a thermostable DNA polymerase (e.g. Taq polymerase), the four deoxynucleotide triphosphates, and a buffer are combined to initiate DNA synthesis. The solution is denatured by heating, then cooled to allow annealing of newly added primer, followed by another round of DNA synthesis. This process is typically repeated for about 30 cycles, resulting in amplification of the target sequence.

Although the use of PCR is suitable, other nucleic acid amplification techniques may also be used, including ligase chain reaction (LCR) and strand displacement amplification (SDA). The high-resolution MS technique allows separation of bioagent spectral lines from background spectral lines in highly cluttered environments.

In another embodiment, the detection scheme for the PCR products generated from the bioagent(s) incorporates at least three features. First, the technique simultaneously detects and differentiates multiple (generally about 6-10) PCR products. Second, the technique provides a molecular mass that uniquely identifies the bioagent from the possible primer sites. Finally, the detection technique is rapid, allowing multiple PCR reactions to be run in parallel.

F. Mass Spectrometric Characterization of Bioagent Identifying Amplicons

Mass spectrometry (MS)-based detection of PCR products provides a means for determination of BCS which has several advantages. MS is intrinsically a parallel detection scheme without the need for radioactive or fluorescent labels, since every amplification product is identified by its molecular mass. The current state of the art in mass spectrometry is such that less than femtomole quantities of material can be readily analyzed to afford information about the molecular contents of the sample. An accurate assessment of the molecular mass of the material can be quickly obtained, irrespective of whether the molecular weight of the sample is several hundred, or in excess of one hundred thousand atomic mass units (amu) or Daltons. Intact molecular ions can be generated from amplification products using one of a variety of ionization techniques to convert the sample to gas phase. These ionization methods include, but are not limited to, electrospray ionization (ES), matrix-assisted laser desorption ionization (MALDI) and fast atom bombardment (FAB). For example, MALDI of nucleic acids, along with examples of matrices for use in MALDI of nucleic acids, are described in WO 98/54751.

In some embodiments, large DNAs and RNAs, or large amplification products therefrom, can be digested with restriction endonucleases prior to ionization. Thus, for example, an amplification product that was 10 kDa could be digested with a series of restriction endonucleases to produce a panel of, for example, 100 Da fragments. Restriction endonucleases and their sites of action are well known to the skilled artisan. In this manner, mass spectrometry can be performed for the purposes of restriction mapping.

Upon ionization, several peaks are observed from one sample due to the formation of ions with different charges. Averaging the multiple readings of molecular mass obtained from a single mass spectrum affords an estimate of molecular mass of the bioagent. Electrospray ionization mass spectrometry (ESI-MS) is particularly useful for very high molecular weight polymers such as proteins and nucleic acids having molecular weights greater than 10 kDa, since it yields a distribution of multiply-charged molecules of the sample without causing a significant amount of fragmentation.

The mass detectors used in the methods of the present invention include, but are not limited to, Fourier transform ion cyclotron resonance mass spectrometry (FT-ICR-MS), ion trap, quadrupole, magnetic sector, time of flight (TOF), Q-TOF, and triple quadrupole.

In general, the mass spectrometric techniques which can be used in the present invention include, but are not limited to, tandem mass spectrometry, infrared multiphoton dissociation and pyrolytic gas chromatography mass spectrometry (PGC-MS). In one embodiment of the invention, the bioagent detection system operates continually in bioagent detection mode using pyrolytic GC-MS without PCR for rapid detection of increases in biomass (for example, increases in fecal contamination of drinking water or of germ warfare agents). To achieve minimal latency, a continuous sample stream flows directly into the PGC-MS combustion chamber. When an increase in biomass is detected, a PCR process is automatically initiated. Bioagent presence produces elevated levels of large molecular fragments from, for example, about 100-7,000 Da which are observed in the PGC-MS spectrum. The observed mass spectrum is compared to a threshold level and when levels of biomass are determined to exceed a predetermined threshold, the bioagent classification process described hereinabove (combining PCR and MS, such as FT-ICR MS) is initiated. Optionally, alarms or other processes (halting ventilation flow, physical isolation) are also initiated by this detected biomass level.

The accurate measurement of molecular mass for large DNAs is limited by the adduction of cations from the PCR reaction to each strand, resolution of the isotopic peaks from natural abundance $^{13}$C and $^{15}$N isotopes, and assignment of the charge state for any ion. The cations are removed by in-line dialysis using a flow-through chip that brings the solution containing the PCR products into contact with a solution containing ammonium acetate in the presence of an electric field gradient orthogonal to the flow. The latter two problems are addressed by operating with a resolving power of >100,000 and by incorporating isotopically depleted nucleotide triphosphates into the DNA. The resolving power of the instrument is also a consideration. At a resolving power of 10,000, the modeled signal from the $(M-14H+)^{14-}$ charge state of an 84 mer PCR product is poorly characterized and assignment of the charge state or exact mass is impossible. At a resolving power of 33,000, the peaks from the individual isotopic components are visible. At a resolving power of 100,000, the isotopic peaks are resolved to the baseline and assignment of the charge state for the ion is straightforward. The ($^{13}$C, $^{15}$N)-depleted triphosphates are obtained, for example, by growing microorganisms on depleted media and harvesting the nucleotides (Batey et al., *Nucl. Acids Res.,* 1992, 20, 4515-4523).

While mass measurements of intact nucleic acid regions are believed to be adequate to determine most bioagents, tandem mass spectrometry (MS$^n$) techniques may provide more definitive information pertaining to molecular identity or sequence. Tandem MS involves the coupled use of two or more stages of mass analysis where both the separation and detection steps are based on mass spectrometry. The first stage is used to select an ion or component of a sample from which further structural information is to be obtained. The selected ion is then fragmented using, e.g., blackbody irradiation, infrared multiphoton dissociation, or collisional activation. For example, ions generated by electrospray ionization (ESI) can be fragmented using IR multiphoton dissociation. This activation leads to dissociation of glycosidic bonds and the phosphate backbone, producing two series of fragment ions, called the w-series (having an intact 3' terminus and a 5' phosphate following internal cleavage) and the a-Base series(having an intact 5' terminus and a 3' furan).

The second stage of mass analysis is then used to detect and measure the mass of these resulting fragments of product ions. Such ion selection followed by fragmentation routines can be performed multiple times so as to essentially completely dissect the molecular sequence of a sample.

If there are two or more targets of similar molecular mass, or if a single amplification reaction results in a product which has the same mass as two or more bioagent reference standards, they can be distinguished by using mass-modifying "tags." In this embodiment of the invention, a nucleotide analog or "tag" is incorporated during amplification (e.g., a 5-(trifluoromethyl)deoxythymidine triphosphate) which has a different molecular weight than the unmodified base so as to improve distinction of masses. Such tags are described in, for example, PCT WO97/33000, which is incorporated herein by reference in its entirety. This further limits the number of possible base compositions consistent with any mass. For example, 5-(trifluoromethyl)deoxythymidine triphosphate can be used in place of dTTP in a separate nucleic acid amplification reaction. Measurement of the mass shift between a conventional amplification product and the tagged product is used to quantitate the number of thymidine nucleotides in each of the single strands. Because the strands are complementary, the number of adenosine nucleotides in each strand is also determined.

In another amplification reaction, the number of G and C residues in each strand is determined using, for example, the cytosine analog 5-methylcytosine (5-meC) or 5-propynylcytosine. The combination of the A/T reaction and G/C reaction, followed by molecular weight determination, provides a unique base composition. This method is summarized in FIG. 4 and Table 1(SEQ ID NOS: 221 and 222).

The mass tag phosphorothioate A (A*) was used to distinguish a *Bacillus anthracis* cluster. The *B. anthracis* ($A_{14}G_9C_{14}T_9$) had an average MW of 14072.26, and the *B. anthracis* ($A_1A^*_{13}G_9C_{14}T_9$) had an average molecular weight of 14281.11 and the phosphorothioate A had an average molecular weight of +16.06 as determined by ESI-TOF MS. The deconvoluted spectra are shown in FIG. 5.

In another example, assume the measured molecular masses of each strand are 30,000.115 Da and 31,000.115 Da respectively, and the measured number of dT and dA residues are (30,28) and (28,30). If the molecular mass is accurate to 100 ppm, there are 7 possible combinations of dG+dC possible for each strand. However, if the measured molecular mass is accurate to 10 ppm, there are only 2 combinations of dG+dC, and at 1 ppm accuracy there is only one possible base composition for each strand.

Signals from the mass spectrometer may be input to a maximum-likelihood detection and classification algorithm such as is widely used in radar signal processing. The detection processing uses matched filtering of BCS observed in mass-basecount space and allows for detection and subtraction of signatures from known, harmless organisms, and for detection of unknown bioagent threats. Comparison of newly observed bioagents to known bioagents is also possible, for estimation of threat level, by comparing their BCS to those of known organisms and to known forms of pathogenicity enhancement, such as insertion of antibiotic resistance genes or toxin genes.

Processing may end with a Bayesian classifier using log likelihood ratios developed from the observed signals and average background levels. The program emphasizes performance predictions culminating in probability-of-detection versus probability-of-false-alarm plots for conditions involving complex backgrounds of naturally occurring organisms and environmental contaminants. Matched filters consist of a priori expectations of signal values given the set of primers used for each of the bioagents. A genomic sequence database (e.g. GenBank) is used to define the mass basecount matched filters. The database contains known threat agents and benign background organisms. The latter is used to estimate and subtract the signature produced by the background organisms. A maximum likelihood detection of known background organisms is implemented using matched filters and a running-sum estimate of the noise covariance. Background signal strengths are estimated and used along with the matched filters to form signatures which are then subtracted. the maximum likelihood process is applied to this "cleaned up" data in

TABLE 1

Mass Tagging of G and C Residues

| Mass tag | Double strand sequence | Single strand Sequence | Total mass this strand | Base info this strand | Base info other strand | Total base comp. Top strand | Total base comp. Bottom strand |
|---|---|---|---|---|---|---|---|
| T*.mass (T*-T) = x | T*ACGT*ACGT* AT*GCAT*GCA | T*ACGT*ACGT* | 3x | 3T | 3A | 3T 2A 2C 2G | 3A 2T 2G 2C |
|  |  | AT*GCAT*GCA | 2x | 2T | 2A |  |  |
| C*.mass (C*-C) = y | TAC*GTAC*GT ATGC*ATGC*A | TAC*GTAC*GT | 2x | 2C | 2G |  |  |
|  |  | ATGC*ATGC*A | 2x | 2C | 2G |  |  | a similar manner employing matched filters for the organisms and a running-sum estimate of the noise-covariance for the cleaned up data.

G. Base Composition Signatures as Indices of Bioagent Identifying Amplicons

Although the molecular mass of amplification products obtained using intelligent primers provides a means for identification of bioagents, conversion of molecular mass data to a base composition signature is useful for certain analyses. As used herein, a "base composition signature" (BCS) is the exact base composition determined from the molecular mass of a bioagent identifying amplicon. In one embodiment, a BCS provides an index of a specific gene in a specific organism.

Base compositions, like sequences, vary slightly from isolate to isolate within species. It is possible to manage this diversity by building "base composition probability clouds" around the composition constraints for each species. This permits identification of organisms in a fashion similar to sequence analysis. A "pseudo four-dimensional plot" can be used to visualize the concept of base composition probability clouds. Optimal primer design requires optimal choice of bioagent identifying amplicons and maximizes the separation between the base composition signatures of individual bioagents. Areas where clouds overlap indicate regions that may result in a misclassification, a problem which is overcome by selecting primers that provide information from different bioagent identifying amplicons, ideally maximizing the separation of base compositions. Thus, one aspect of the utility of an analysis of base composition probability clouds is that it provides a means for screening primer sets in order to avoid potential misclassifications of BCS and bioagent identity.

Another aspect of the utility of base composition probability clouds is that they provide a means for predicting the identity of a bioagent whose exact measured BCS was not previously observed and/or indexed in a BCS database due to evolutionary transitions in its nucleic acid sequence.

It is important to note that, in contrast to probe-based techniques, mass spectrometry determination of base composition does not require prior knowledge of the composition in order to make the measurement, only to interpret the results. In this regard, the present invention provides bioagent classifying information similar to DNA sequencing and phylogenetic analysis at a level sufficient to detect and identify a given bioagent. Furthermore, the process of determination of a previously unknown BCS for a given bioagent (for example, in a case where sequence information is unavailable) has downstream utility by providing additional bioagent indexing information with which to populate BCS databases. The process of future bioagent identification is thus greatly improved as more BCS indexes become available in the BCS databases.

Another embodiment of the present invention is a method of surveying bioagent samples that enables detection and identification of all bacteria for which sequence information is available using a set of twelve broad-range intelligent PCR primers. Six of the twelve primers are "broad range survey primers" herein defined as primers targeted to broad divisions of bacteria (for example, the *Bacillus/Clostridia* group or gamma-proteobacteria). The other six primers of the group of twelve primers are "division-wide" primers herein defined as primers which provide more focused coverage and higher resolution. This method enables identification of nearly 100% of known bacteria at the species level. A further example of this embodiment of the present invention is a method herein designated "survey/drill-down" wherein a subspecies characteristic for detected bioagents is obtained using additional primers. Examples of such a subspecies characteristic include but are not limited to: antibiotic resistance, pathogenicity island, virulence factor, strain type, sub-species type, and clade group. Using the survey/drill-down method, bioagent detection, confirmation and a subspecies characteristic can be provided within hours. Moreover, the survey/drill-down method can be focused to identify bioengineering events such as the insertion of a toxin gene into a bacterial species that does not normally make the toxin.

H. Use of Bioagent Identifying Amplicons for Identification of RNA Viruses

Coronaviruses represent RNA virus examples of bioagents which can be identified by the methods of the present invention.

Examples of (−)-strand RNA viral genera include arenaviruses, bunyaviruses, and mononegavirales. Species that are members of the arenavirus genus include, but are not limited to, are sabia virus, lassa fever virus, Machupo Virus, Argentine hemorrhagic fever virus, and flexal virus. Species that are members of the bunyavirus genus include, but are not limited, to hantavirus, nairovirus, phlebovirus, hantaan virus, Congo-Crimean hemorrhagic fever, and rift valley fever. Species that are members of the monoegavirales genus include, but are not limited to, filovirus, paramyxovirus, ebola virus, Marburg, and equine morbillivirus.

Examples of (+)-strand RNA viral genera include, but are not limited to, picornaviruses, astroviruses, calciviruses, nidovirales, flaviviruses, and togaviruses. Species of the picornavirus genus include, but are not limited to, coxsackievirus, echovirus, human coxsackievirus A, human echovirus, human enterovirus, human poliovirus, hepatitis A virus, human parechovirus, and human rhinovirus. A species of the astrovirus genus, includes but is not limited to, human astrovirus. Species of the calcivirus genus include, but are not limited to, chiva virus, human calcivirus, and norwalk virus. Species of the nidovirales genus include, but are not limited to coronavirus and torovirus. Species of the flavivirus genus include, but are not limited to, Alfuy virus, Alkhurma virus, Apoi virus, Aroa virus, Bagaza virus, Banzi virus, Batu cave virus, Bouboui virus, Bukalasa bat virus, Bussliquara virus, Cacipacore virus, Carey island virus, Cowbone ridge virus, Dakar bat virus, Deer tick virus, Dengue virus type 1, Dengue virus type 2, Dengue virus type 3, Dengue virus type 4, Edge hill virus, Entebbe bat virus, Flavivirus sp., Gadgets gully virus, Hepatitis C virus, Iguape virus, Ilheus virus, Israel turkey meningoencephalitis virus, Japanese encephalities virus, Jugra virus, Jutiapa virus, Kadam virus, Kedougou virus, Kokobera virus, Koutango virus, Kunjin virus, Kyasanur forest disease virus, Langata virus, Louping III virus, Maeban virus, Modoc virus, Montana myotic leukoencephalitis virus, Murray Valley encephalitis virus, Naranjal virus, Negishi virus, Ntaya virus, Omsk hemorrhagic fever virus, Phnom-Penh bat virus, Potiskum virus, Powassan virus, Rio bravo virus, Rocio virus, Royal farm virus, Russian spring-summer encephalitis virus, Saboya virus, Saint Louis encephalitis virus, Sal vieja virus, San perlita virus, Saumarez reef virus, Sepik virus, Sitiawan virus, Sokuluk virus, Spondweni virus, Stratford virus, Tembusu virus, Tick-borne encephalitis virus, Tyulenly virus, Uganda 5 virus, Usutu virus, West Nile virus, and Yellow fever virus. Species of the togavirus genus include, but are not limited to, Chikugunya virus, Eastern equine encephalitis virus, Mayaro virus, O'nyong-nyong virus, Ross river virus, Venezuelan equine encephalitis virus, Rubella virus, and hepatitis E virus. The hepatitis C virus has a 5'-untranslated region of 340 nucleotides, an open reading frame encoding 9 proteins having 3010 amino acids and a 3'-untranslated region of 240 nucleotides. The 5'-UTR and 3'-UTR are 99% conserved in hepatitis C viruses.

Species of retroviruses include, but are not limited to, human immunodeficiency virus and hepatitis B virus.

In one embodiment of the present invention, the target gene is an RNA-dependent RNA polymerase or a helicase encoded by (+)-strand RNA viruses, or RNA polymerase from a (−)-strand RNA virus. (+)-strand RNA viruses are double stranded RNA and replicate by RNA-directed RNA synthesis using RNA-dependent RNA polymerase and the positive strand as a template. Helicase unwinds the RNA duplex to allow replication of the single stranded RNA. These viruses include viruses from the genera picornaviridae, togaviridae, flaviviradae, arenaviridae, cononaviridae (e.g., human respiratory virus) and Hepatitis A virus. The genes encoding these proteins comprise variable and highly conserved regions which flank the variable regions. The genes can be used to identify-the species of the virus and if necessary the strain of the viral species.

In some embodiments of the present invention, RNA viruses are identified by first obtaining RNA from an RNA virus, obtaining corresponding DNA from the RNA via reverse transcription, amplifying the DNA to obtain one or more amplification products using one or more pairs of oligonucleotide primers that bind to conserved regions of the RNA viral genome, which flank a variable region of the genome, determining the molecular mass or base composition of the one or more amplification products and comparing the molecular masses or base compositions with calculated or experimentally determined molecular masses or base compositions of known RNA viruses wherein at least one match identifies the RNA virus.

In one embodiment of the present invention, the RNA virus is a coronavirus. In other embodiments, the coronavirus includes but is not limited to, a member of the following group of coronaviruses: avian infectious bronchitis, bovine coronavirus, canine coronavirus, feline infectious peritonitis virus, human coronavirus 229E, human coronavirus OC43, murine hepatitis virus, porcine epidemic diarrhea virus, porcine hemagglutinating encephalomyelitis virus, rat sialodacryoadenitis coronavirus, SARS coronavirus, transmissible gastroenteritis virus and turkey coronavirus.

In other embodiments of the present invention, the intelligent primers produce bioagent identifying amplicons within stable and highly conserved regions of coronaviral genomes. The advantage to characterization of an amplicon in a highly conserved region is that there is a low probability that the region will evolve past the point of primer recognition, in which case, the amplification step would fail. Such a primer set is thus useful as a broad range survey-type primer. In one embodiment of the present invention, an example of a highly conserved region of coronaviruses is the gene encoding RNA-dependent RNA polymerase (RdRp). In another embodiment of the present invention, the intelligent primers produce bioagent identifying amplicons in a region which evolves more quickly than the stable region described above. The advantage of characterization bioagent identifying amplicon corresponding to an evolving genomic region is that it is useful for distinguishing emerging strain variants. In another embodiment, an example of an evolving genomic region of coronaviruses is the gene encoding nsp11.

The present invention also has significant advantages as a platform for identification of diseases caused by emerging coronaviruses. The present invention eliminates the need for prior knowledge of sequence to generate hybridization probes. Thus, in another embodiment, the present invention provides a means of determining the etiology of a coronavirus infection when the process of identification of coronaviruses is carried out in a clinical setting and, even when the coronavirus is a new species never observed before (as used herein, the term "etiology" refers to the causes or origins, of diseases or abnormal physiological conditions). This is possible because the methods are not confounded by naturally occurring evolutionary variations (a major concern for characterization of viruses which evolve rapidly) occurring in the sequence acting as the template for production of the bioagent identifying amplicon. Measurement of molecular mass and determination of base composition is accomplished in an unbiased manner without sequence prejudice.

Another embodiment of the present invention also provides a means of tracking the spread of any species or strain of coronavirus when a plurality of samples obtained from different locations are analyzed by the methods described above in an epidemiological setting. In one embodiment, a plurality of samples from a plurality of different locations are analyzed with primers which produce bioagent identifying amplicons, a subset of which contain a specific coronavirus. The corresponding locations of the members of the coronavirus-containing subset indicate the spread of the specific coronavirus to the corresponding locations.

In another embodiment, the present invention also provides kits for carrying out the methods described herein. In some embodiments, the kit may comprise a sufficient quantity of one or more primer pairs to perform an amplification reaction on a target polynucleotide from a bioagent to form a bioagent identifying amplicon. In some embodiments, the kit may comprise from one to fifty primer pairs, from one to twenty primer pairs, from one to ten primer pairs, or from two to five primer pairs. In some embodiments, the kit may comprise one or more primer pairs recited in Table 2. In some embodiments, the kit may comprise broad range survey primers, division wide primers, or drill-down primers, or any combination thereof. A kit may be designed so as to comprise particular primer pairs for identification of a particular bioagent. For example, a broad range survey primer kit may be used initially to identify an unknown bioagent as a coronavirus. Another kit may be used to distinguish any coronavirus from any other coronavirus. In some embodiments, any of these kits may be combined to comprise a combination of broad range survey primers and division-wide primers so as to be able to identify the species of an unknown bioagent.

The kit may also comprise a sufficient quantity of reverse transcriptase, a DNA polymerase, suitable nucleoside triphosphates (including any of those described above), a DNA ligase, and/or reaction buffer, or any combination thereof, for the amplification processes described above. A kit may further include instructions pertinent for the particular embodiment of the kit, such instructions describing the primer pairs and amplification conditions for operation of the method. A kit may also comprise amplification reaction containers such as microcentrifuge tubes and the like. A kit may also comprise reagents for isolating bioagent nucleic acid, including, for example, detergent. A kit may also comprise a table of measured or calculated molecular masses and/or base compositions of bioagents using the primer pairs of the kit.

The present invention is also directed to methods of characterizing a double etiology of a subject presenting at least one symptom of SARS comprising: contacting nucleic acid from a sample from the subject with a first pair of oligonucleotide primers which hybridize to conserved sequences of a coronavirus, wherein said conserved sequences of a coronavirus flank a variable nucleic acid sequence; contacting nucleic acid from the sample with a second pair of oligonucleotide primers which hybridize to conserved sequences of a putative secondary bioagent(s), wherein the sequences of putative secondary bioagents flank a variable sequence; amplifying the variable nucleic acid sequences between the first pair of primers and the second pair of primers to produce a coronavirus amplification product and a secondary bioagent amplification product; determining the base composition signature of each of the amplification products; using the base composition signatures of each of the amplification products to identify the combination of a SARS-linked coronavirus and a secondary bioagent as a probable cause of the at least one symptom of SARS. In some embodiments, the secondary bioagent correlates with increased severity of the at least one symptom of SARS. In some embodiments, the secondary bioagent correlates with increased incidence of mortality of subjects presenting the at least one symptom of SARS. In some embodiments, the at least one symptom of SARS is high fever (>38° C.), dry cough, shortness of breath, headache, muscular stiffness, loss of appetite, malaise, confusion, rash, or diarrhea, or any combination thereof. In some embodiments, the double etiology comprises a synergistic viral infection of a SARS-linked coronavirus and a secondary virus. In some embodiments, the secondary virus is adenovirus, parainfluenza virus, respiratory syncytial virus, measles virus, chicken pox virus, or influenza virus, or any combination thereof. In some embodiments, the double etiology comprises a synergistic viral/bacterial infection of a SARS-linked coronavirus and a secondary bacterial agent. In some embodiments, the secondary bacterial agent is *Streptococcus pneumoniae, Mycoplasma pneumoniae*, or *Chlamydia trachomatis*, or any combination thereof. In some embodiments, the contacting steps are performed in parallel. In some embodiments, the contacting steps are performed simultaneously.

The present invention is also directed to methods of identifying the etiology of a subject presenting at least one symptom of SARS comprising: employing the method described above to rule out the presence of a SARS-linked coronavirus in a sample, wherein lack of amplification of a SARS-linked coronavirus by the first pair of primers indicates absence of a SARS-linked coronavirus, and wherein the base composition signature of the amplification product of the second pair of primers identifies the secondary bioagent, thereby indicating the etiology of the at least one symptom of SARS. In some embodiments, the secondary bioagent is the cause of an acute respiratory infection. In some embodiments, the secondary bioagent is a bacterial agent such as, for example, *Streptococcus pneumoniae, Mycoplasma pneumoniae* or *Chlalmydia trachomatis*. In some embodiments, the secondary bioagent is a viral agent such as, for example, adenoviruses, parainfluenza, respiratory syncytial virus, measles virus, chicken pox virus, or influenza virus.

EXAMPLES

Example 1

Coronavirus Samples, Nucleic Acid Isolation and Amplification

HRT-18 and MRC5 cell lines were inoculated with HCoV-OC43 and HcoV-229E (University of Colorado and Naval Health Research Center, San Diego, Calif.), HcoV-229E. SARS RNA was obtained the CDC (Atlanta, Ga.) as a 1 mL extract of SARS coronavirus in TRIzol extraction buffer. The SARS CoV-Tor2 strain was obtained from the University of Manitoba as a cell culture supernatant from infected Vero-E6 cells.

RNA was isolated from 250 µL of coronavirus infected cells or culture supernatant using Trizol or Trizol LS respectively (Invitrogen Inc., Carlsbad, Calif.) according to the manufacturer's protocol. 5 µg of sheared poly A DNA was added for the precipitation of the RNA. The pelleted nucleic acids were washed in 70% ethanol and resuspended in 100 µL DEPC-treated water containing 20 units of Superase•In™ (Ambion, Austin, Tex.). The resuspended RNA was purified using the Qiagen RNAeasy mini kit according to the manufacturer's protocol. The RNA was eluted from the RNAeasy™ columns in 30 µL of DEPC-treated water and was stored at −70° C.

Purified RNA was primed for reverse transcription by mixing 10 µL of the purified RNA with 5 µL DEPC-treated water containing 500 ng random primers, 1 µg of sheared poly-A DNA and 10 units Superase•In™. The mixture was heated to 60° C. for 5 minutes and then cooled to 4° C. Following the annealing of the random primers to the RNA, 15 µL of first strand reaction mix consisting of 2× first strand buffer (Invitrogen Inc., Carlsbad, Calif.), 10 mM DTT, 500 µM dNTPs, and 75 units of SuperScript II was added to the RNA primer mixture. The RNA was reversed transcribed for 45 minutes at 45° C. Various dilutions of the reverse transcription reaction mixes were used directly in the PCR reactions.

All PCR reactions were performed in 50 µL using 96-well microtiter plates and M.J. Dyad thermocyclers (MJ research, Waltham, Mass.). The PCR reaction buffer consisted of 4 units of Amplitaq Gold, 1× buffer II (Applied Biosystems, Foster City, Calif.), 2.0 mM $MgCl_2$, 0.4 M betaine, 800 µM dNTP mix, and 250 nM propyne containing PCR primers. The following PCR conditions were used to amplify coronavirus sequences: 95° C. for 10 min followed by 50 cycles of 95° C. for 30 sec, 50° C. for 30 sec, and 72° C. for 30 sec.

20 µL of each crude PCR product was transferred into a 96-well plate. Pretreated anion exchange ZipTips™ (Millipore) were loaded onto the head of a 96-tip Evolution P3 (Perkin Elmer), and then a 20 µL aliquot of crude PCR product was loaded onto each tip by repeatedly aspirating and expelling the 20 µL aliquot. Following sample loading, aliquots of 40 mM $NH_4HCO_3$ were used to wash each sample six times to remove unconsumed primers and dNTPs. This step was followed by rinses with 10 µL aliquots of a 20% MeOH solution to remove any residual polymeric material that originated from polymerase or PCR buffer. Elution of the final purified/desalted PCR products was accomplished by rinsing each tip with a 10 µL aliquot of 0.4 M $NH_4OH$ and dispensing the 10 µL eluent into a well of a 96-well plate. Prior to analysis by ESI-MS, the eluent was diluted 1:1 with a solution containing 50% MeOH and 50 mM piperidine/imidizaole. A small oligonucleotide designated SH2 (CGT-GCATGGCGG; SEQ ID NO:105, Synthetic Genetics, San Diego, Calif.) was added as an internal mass standard at a final concentration of 50 nM.

Example 2

Molecular Mass Determination

The mass spectrometer is based on a Bruker Daltonics (Billerica, Mass.) Apex II 70e electrospray ionization Fourier transform ion cyclotron resonance mass spectrometer (ESI-FTICR -MS) that employs an actively shielded 7 Tesla superconducting magnet. All aspects of pulse sequence control and data acquisition were performed on a 1.1 GHz Pentium II data station running Bruker's Xmass software. 20 µL sample aliquots were extracted directly from 96-well microtiter plates using a CTC HTS PAL autosampler (LEAP Technologies, Carrboro, N.C.) triggered by the data station. Samples were injected directly into the ESI source at a flow rate of 75 μL/hr. Ions were formed via electrospray ionization in a modified Analytica (Branford, Conn.) source employing an off axis, grounded electrospray probe positioned ca. 1.5 cm from the metalized terminus of a glass desolvation capillary. The atmospheric pressure end of the glass capillary is biased at 6000 V relative to the ESI needle during data acquisition. A countercurrent flow of dry $N_2/O_2$ was employed to assist in the desolvation process. Ions were accumulated in an external ion reservoir comprised of an rf-only hexapole, a skimmer cone, and an auxiliary gate electrode, prior to injection into the trapped ion cell where they were mass analyzed. Spectral acquisition was performed in the continuous duty cycle mode whereby ions were accumulated in the hexapole ion reservoir simultaneously with ion detection in the trapped ion cell. Following a 1.2 ms transfer event, in which ions were transferred to the trapped ion cell, the ions were subjected to a 1.6 ms chirp excitation corresponding to 8000-500 m/z. Data was acquired over an m/z range of 500-5000 (1M data points over a 225K Hz bandwidth). Each spectrum was the result of co-adding 32 transients. Transients were zero-filled once prior to the magnitude mode Fourier transform and post calibration using the internal mass standard. The ICR-2LS software package (G. A. Anderson, J. E. Bruce. (Pacific Northwest National Laboratory, Richland, Wash., 1995)) was used to deconvolute the mass spectra and calculate the mass of the monoisotopic species using an "averaging" fitting routine (M. W. Senko, S. C. Beu, F. W. McLafferty, Journal of the American Society for Mass Spectrometry 6, 229 (1995)) modified for DNA. Using this approach, monoisotopic molecular weights were calculated.

Example 3

Selection of Primers

To design primers that amplify all known coronavirus species and to identify new members, alignments were carried out using all available coronavirus sequences from GenBank, including complete genomes and individual genes, and scanned for regions where pairs of PCR primers would generate bioagent identifying amplicons of a length of about 150 or fewer nucleobases. The current length limit of about 150 nucleobases is dictated by the ability of electrospray mass spectroscopy to determine the mass of a PCR amplification product with sufficient accuracy to unambiguously determine the base composition. One with ordinary skill in the art will recognize that this limit may increase subject to improvements in the art of molecular mass determination of nucleic acids.

Two target regions were selected in coronavirus orf-1b, one in the RNA-dependent RNA polymerase (RdRp) and the other in Nsp11 (FIG. 7). Locations of primers within these regions were optimized for sensitivity and broad-range priming potential simultaneously by performing limiting dilutions of multiple, diverse coronaviruses. The primer pair names shown in Table 2 refer to the forward and reverse primer for a given region. Each primer was designed to include a thymidine (T) nucleotide on the 5' end to minimize addition of non-templated adenosine (A) during PCR.

Table 2 represents the collection of intelligent primers (SEQ ID NOs:5-11) designed to identify coronaviruses using the method of the present invention. The forward or reverse primer name indicates the gene region of coronavirus genome to which the primer hybridizes relative to a reference sequence, in this case, the human coronavirus 229E sequence. The primers represented by SEQ ID NOs:5 and 6 were designed to yield an amplicon originating from a coronavirus nsp11 gene with reference to GenBank Accession No: NC_002645 (incorporated herein as SEQ ID NO:30). The primers represented by SEQ ID NOs:7-11 were designed to yield an amplicon originating from a coronavirus RNA-dependent RNA polymerase gene with reference to GenBank Accession No: AF304460 (incorporated herein as SEQ ID NO: 31). In Table 2, @=5-propynyluracil (which is a chemically modified version of T); &=5-propynylcytosine (which is a chemically modified version of C).

TABLE 2

Primer Pairs for Identification of Coronaviruses

| Forward primer name | Forward sequence | SEQ ID NO: | Reverse primer name | Reverse sequence | SEQ ID NO: |
|---|---|---|---|---|---|
| CV_NC002645_18190_18215_F | TGTTTGTTTTGGAATTGTAATGTTGA | 5 | CV_NC002645_18302_18326_R | TGGAATGCATGCTTATTAACATACA | 6 |
| CV_NC002645_18190_182152_F | TGTTTG&&&&GGAATTGTAATGTTGA | 5 | CV_NC002645_18302_18326_2_R | TGGAATGCATGC&&A&&AACATACA | 6 |
| CVPOL_AF304460_1737_1757_F | TAAGTTTTATGGCGGGTGGGA | 7 | CVPOL_AF304460_1804_1824_R | TTTAGGGTAGTCCCAACCCAT | 8 |
| CVPOL_AF304460_1737_1755_F | TAAGTTTTATGGCGGGTGG | 9 | CVPOL_AF304460_1804_1824_2_R | TTTAGGGTAGTCCCAACCCAT | 8 |
| CVPOL_AF304460_1737_1755P_F | TAAG&&T&ATGGCGGG&GG | 9 | CVPOL_AF304460_1804_1824_2_R | TTTAGGATAGT@@@AACCCAT | 10 |
| CVPOL_AF304460_1737_1755_2_F | TAAGTTTTATGGCGGCTGG | 11 | CVPOL_AF304460_1804_1824_2_R | TTTAGGGTAGTCCCAACCCAT | 8 |
| CVPOL_AF304460_1737_1755_2P_F | TAAG&&T&ATGGCGGC&GG | 11 | CVPOL_AF304460_1804_1824_2P_R | TTTAGGATAGT@@@AACCCAT | 10 |
| CVPOL_AF304460_1737_1755_F | TAAGTTTTATGGCGGGTGG | 9 | CV2OL_AF304460_1804_1824_3_R | TTTAGGATAGTCCCAACCCAT | 10 |

Example 4

Database of Bioagent Identifying Amplicons for Coronaviruses

A database of expected molecular masses and base compositions of bioagent identifying amplicons was generated using an electronic PCR search algorithm (ePCR). An existing RNA structure search algorithm (T. Macke et al., *Nuc. Acids Res.* 29, 4724 (2001)) was modified to include PCR parameters such as hybridization conditions, mismatches, and thermodynamic calculations (J. SantaLucia, *Proc. Natl. Acad. Sci. U.S.A* 95, 1460 (1998)). ePCR was used first to check primer specificity and the selected primer pairs were searched against GenBank nucleotide sequence database for matches to the primer sequences. ePCR showed that the coronavirus primers should prime all known coronaviruses in GenBank, but should not prime bacterial, viral, or human DNA sequences. For each match, A, G, C, and T base counts of the predicted amplicon sequence were calculated and a database of coronavirus bioagent identifying amplicons was created (Table 3).

Shown in Table 3 are molecular masses and base compositions of both strands of bioagent identifying amplicons for a series of different coronaviruses obtained using primer sets CV_NC002645_18190_18215P_F (nsp11 primer set SEQ ID NOs: 5 and 6) and VPOL_AF304460_1737_1755P_F (RdRp primer set SEQ ID NOs: 9 and 10).

TABLE 3

Database of Molecular Masses and Base Compositions for Coronavirus Bioagent Identifying Amplicons

| Primer Pair | Coronavirus | STRAIN | ACCESSION | SEQ ID NO: | Forward Strand Exact Mass | Forward Strand Base Composition | Opposite Strand Exact Mass | Opposite Strand Base Composition |
|---|---|---|---|---|---|---|---|---|
| RdRp | Avian infectious bronchitis virus | Beaudette | Z30541.1 | 12 | 27396.5334 | A24 G24 C14 T26 | 27032.54201 | A26 G14 C24 T24 |
| nsp11 | Avian infectious bronchitis virus | Beaudette | Z30541.1 | 12 | 42530.9462 | A33 G32 C17 T55 | 42129.10847 | A55 G17 C32 T33 |
| RdRp | Avian infectious bronchitis virus | Beaudette | Z69629.1 | 13 | 27396.5334 | A24 G24 C14 T26 | 27032.54201 | A26 G14 C24 T24 |
| RdRp | Avian infectious bronchitis virus | Beaudette | M95169.1 | 14 | 27396.5334 | A24 G24 C14 T26 | 27032.54201 | A26 G14 C24 T24 |
| nsp11 | Avian infectious bronchitis virus | Beaudette | M95169.1 | 14 | 42530.9462 | A33 G32 C17 T55 | 42129.10847 | A55 G17 C32 T33 |
| RdRp | Avian infectious bronchitis virus | Beaudette | NC_001451.1 | 15 | 27396.5334 | A24 G24 C14 T26 | 27032.54201 | A26 G14 C24 T24 |
| nsp11 | Avian infectious bronchitis virus | Beaudette | NC_001451.1 | 15 | 42530.9462 | A33 G32 C17 T55 | 42129.10847 | A55 G17 C32 T33 |
| RdRp | Avian infectious bronchitis virus | Beaudette (M42) | M94356.1 | 16 | 27396.5334 | A24 G24 C14 T26 | 27032.54201 | A26 G14 C24 T24 |
| nsp11 | Avian infectious bronchitis virus | Beaudette (M42) | M94356.1 | 16 | 42530.9462 | A33 G32 C17 T55 | 42129.10847 | A55 G17 C32 T33 |
| RdRp | Avian infectious bronchitis virus | Beaudette CK | AJ311317.1 | 17 | 27396.5334 | A24 G24 C14 T26 | 27032.54201 | A26 G14 C24 T24 |
| nsp11 | Avian infectious bronchitis virus | Beaudette CK | AJ311317.1 | 17 | 42530.9462 | A33 G32 C17 T55 | 42129.10847 | A55 G17 C32 T33 |
| RdRp | Avian infectious bronchitis virus | BJ | AY319651.1 | 18 | 27413.56129 | A27 G23 C13 T25 | 27013.52362 | A25 G13 C23 T27 |
| nsp11 | Avian infectious bronchitis virus | BJ | AY319651.1 | 18 | 42502.91625 | A31 G31 C16 T59 | 42155.14792 | A59 G16 C31 T31 |
| RdRp | Avian infectious bronchitis virus | LX4 | AY223860.1 | 19 | 27419.54938 | A26 G23 C12 T27 | 27006.54027 | A27 G12 C23 T26 |

TABLE 3-continued

Database of Molecular Masses and Base Compositions for Coronavirus Bioagent Identifying Amplicons

| Primer Pair | Coronavirus | STRAIN | ACCESSION | SEQ

TABLE 3-continued

Database of Molecular Masses and Base Compositions for Coronavirus Bioagent Identifying Amplicons

| Primer Pair | Coronav

TABLE 3-continued

Database of Molecular Masses and Base Compositions for Coronavirus Bioagent Identifying Amplicons

| Primer Pair | Coronavirus | STRAIN | ACCESSION | SEQ ID NO: | Forward Strand Exact Mass | Forward Strand Base Composition | Opposite Strand Exact Mass | Opposite Strand Base Composition |
|---|---|---|---|---|---|---|---|---|
| RdRp | SARS coronavirus | GZ01 | AY278489.1 | 60 | 27298.53569 | A27 G19 C14 T28 | 27125.56347 | A28 G14 C19 T27 |
| RdRp | SARS coronavirus | HKU-39849 | AY278491.2 | 61 | 27298.53569 | A27 G19 C14 T28 | 27125.56347 | A28 G14 C19 T27 |
| nsp11 | SARS coronavirus | HKU-39849 | AY278491.2 | 61 | 42519.96525 | A34 G33 C20 T50 | 42144.07041 | A50 G20 C33 T34 |
| nsp11 | SARS coronavirus | HSR 1 | AY323977.2 | 62 | 42519.96525 | A34 G33 C20 T50 | 42144.07041 | A50 G20 C33 T34 |
| RdRp | SARS coronavirus | HSR 1 | AY323977.1 | 63 | 27298.53569 | A27 G19 C14 T28 | 27125.56347 | A28 G14 C19 T27 |
| RdRp | SARS coronavirus | HSR 1 | AY323977.1 | 63 | 27298.53569 | A27 G19 C14 T28 | 27125.56347 | A28 G14 C19 T27 |
| RdRp | SARS coronavirus | Shanghai LY | AY322206.1 | 64 | 27298.53569 | A27 G19 C14 T28 | 27125.56347 | A28 G14 C19 T27 |
| RdRp | SARS coronavirus | Sin2500 | AY283794.1 | 65 | 27298.53569 | A27 G19 C14 T28 | 27125.56347 | A28 G14 C19 T27 |
| nsp11 | SARS coronavirus | Sin2500 | AY283794.1 | 65 | 42519.96525 | A34 G33 C20 T50 | 42144.07041 | A50 G20 C33 T34 |
| RdRp | SARS coronavirus | Sin2677 | AY283795.1 | 66 | 27298.53569 | A27 G19 C14 T28 | 27125.56347 | A28 G14 C19 T27 |
| nsp11 | SARS coronavirus | Sin2677 | AY283795.1 | 66 | 42519.96525 | A34 G33 C20 T50 | 42144.07041 | A50 G20 C33 T34 |
| RdRp | SARS coronavirus | Sin2679 | AY283796.1 | 67 | 27298.53569 | A27 G19 C14 T28 | 27125.56347 | A28 G14 C19 T27 |
| nsp11 | SARS coronavirus | Sin2679 | AY283796.1 | 67 | 42519.96525 | A34 G33 C20 T50 | 42144.07041 | A50 G20 C33 T34 |
| RdRp | SARS coronavirus | Sin2748 | AY283797.1 | 68 | 27298.53569 | A27 G19 C14 T28 | 27125.56347 | A28 G14 C19 T27 |
| nsp11 | SARS coronavirus | Sin2748 | AY283797.1 | 68 | 42519.96525 | A34 G33 C20 T50 | 42144.07041 | A50 G20 C33 T34 |
| nsp11 | SARS coronavirus | Shanghai QXC | AY322198.1 | 69 | 42504.96559 | A34 G33 C21 T49 | 42160.06533 | A49 G21 C33 T34 |
| RdRp | SARS coronavirus | Sin2774 | AY283798.1 | 69 | 27298.53569 | A27 G19 C14 T28 | 27125.56347 | A28 G14 C19 T27 |
| nsp11 | SARS coronavirus | Sin2774 | AY283798.1 | 69 | 42519.96525 | A34 G33 C20 T50 | 42144.07041 | A50 G20 C33 T34 |
| RdRp | SARS coronavirus | Taiwan TC1 | AY338174.1 | 70 | 27298.53569 | A27 G19 C14 T28 | 27125.56347 | A28 G14 C19 T27 |
| nsp11 | SARS coronavirus | Taiwan TC1 | AY338174.1 | 70 | 42519.96525 | A34 G33 C20 T50 | 42144.07041 | A50 G20 C33 T34 |
| RdRp | SARS coronavirus | Taiwan TC2 | AY338175.1 | 71 | 27298.53569 | A27 G19 C14 T28 | 27125.56347 | A28 G14 C19 T27 |
| nsp11 | SARS coronavirus | Taiwan TC2 | AY338175.1 | 71 | 42519.96525 | A34 G33 C20 T50 | 42144.07041 | A50 G20 C33 T34 |
| RdRp | SARS coronavirus | Taiwan TC3 | AY348314.1 | 72 | 27298.53569 | A27 G19 C14 T28 | 27125.56347 | A28 G14 C19 T27 |
| nsp11 | SARS coronavirus | Taiwan TC3 | AY348314.1 | 72 | 42519.96525 | A34 G33 C20 T50 | 42144.07041 | A50 G20 C33 T34 |
| RdRp | SARS coronavirus | Tor2 | AY274119.1 | 73 | 27298.53569 | A27 G19 C14 T28 | 27125.56347 | A28 G14 C19 T27 |
| RdRp | SARS coronavirus | Tor2 | AY274119.1 | 73 | 27298.53569 | A27 G19 C14 T28 | 27125.56347 | A28 G14 C19 T27 |
| RdRp | SARS coronavirus | Tor2 | AY274119.2 | 74 | 27298.53569 | A27 G19 C14 T28 | 27125.56347 | A28 G14 C19 T27 |
| nsp11 | SARS coronavirus | Tor2 | AY274119.3 | 75 | 42519.96525 | A34 G33 C20 T50 | 42144.07041 | A50 G20 C33 T34 |
| RdRp | SARS coronavirus | TW1 | AY291451.1 | 76 | 27298.53569 | A27 G19 C14 T28 | 27125.56347 | A28 G14 C19 T27 |
| nsp11 | SARS coronavirus | TW1 | AY291451.1 | 76 | 42519.96525 | A34 G33 C20 T50 | 42144.07041 | A50 G20 C33 T34 |
| RdRp | SARS coronavirus | TWC | AY321118.1 | 77 | 27298.53569 | A27 G19 C14 T28 | 27125.56347 | A28 G14 C19 T27 |
| nsp11 | SARS coronavirus | TWC | AY321118.1 | 77 | 42519.96525 | A34 G33 C20 T50 | 42144.07041 | A50 G20 C33 T34 |
| RdRp | SARS coronavirus | TWC2 | AY362698.1 | 78 | 27298.53569 | A27 G19 C14 T28 | 27125.56347 | A28 G14 C19 T27 |
| nsp11 | SARS coronavirus | TWC2 | AY362698.1 | 78 | 42519.96525 | A34 G33 C20 T50 | 42144.07041 | A50 G20 C33 T34 |
| RdRp | SARS coronavirus | TWC3 | AY362699.1 | 79 | 27298.53569 | A27 G19 C14 T28 | 27125.56347 | A28 G14 C19 T27 |
| nsp11 | SARS coronavirus | TWC3 | AY362699.1 | 79 | 42519.96525 | A34 G33 C20 T50 | 42144.07041 | A50 G20 C33 T34 |

TABLE 3-continued

Database of Molecular Masses and Base Compositions for Coronavirus Bioagent Identifying Amplicons

| Primer Pair | Coronavirus | STRAIN | ACCESSION | SEQ ID NO: | Forward Strand

TABLE 3-continued

Database of Molecular Masses and Base Compositions for Coronavirus Bioagent Identifying Amplicons

| Primer Pair | Coronavirus | STRAIN | ACCESSION | SEQ ID NO: | Forward Strand Exact Mass | Forward Strand Base Composition | Opposite Strand Exact Mass | Opposite Strand Base Composition |
|---|---|---|---|---|---|---|---|---|
| RdRp | Feline infectious peritonitis virus | WSU 79-1683; VR-989 | Seq. In-house | 97 | 27471.53173 | A24 G24 C9 T31 | 26952.56743 | A31 G9 C24 T24 |
| nsp11 | Feline infectious peritonitis virus | WSU 79-1683; VR-989 | Seq. In-house | 97 | 42490.94005 | A33 G31 C18 T55 | 42169.11462 | A55 G18 C31 T33 |
| nsp11 | Feline infectious peritonitis virus | DF2; VR-2004 | Seq. In-house | 98 | 42500.94687 | A33 G32 C19 T53 | 42161.0983 | A53 G19 C32 T33 |
| nsp11 | Human coronavirus OC43 | OC43; NHRC | Seq. In-house | 99 | 42580.99689 | A38 G31 C15 T53 | 42076.07203 | A53 G15 C31 T38 |
| nsp11 | Rat sialodacryoadenitis coronavirus | 8190; VR1410 | Seq. In-house | 100 | | A34 G34 C20 T49 | | A49 G20 C34 T34 |
| nsp11 | Murine hepatitis virus | MHV1-VR261 | Seq. In-house | 101 | 42602.00577 | A37 G34 C18 T48 | 42061.03465 | A48 G18 C34 T37 |

Entries with "Seq. In-house" indicate that a GenBank record did not exist at the time of assembly of the database of Table 3. To verify the experimentally measured base compositions, approximately 500 base pair (bp) regions flanking each target region used in this study were sequenced. The regions surrounding the target regions (615 bp for nsp11 and 454 bp for RdRp) were amplified using primers containing 5' M13 sequencing tags. Methods of sequencing are well known to those with ordinary skill in the art.

Example 5

Characterization of Bioagent Identifying Amplicons for Coronaviruses

Figure 8:
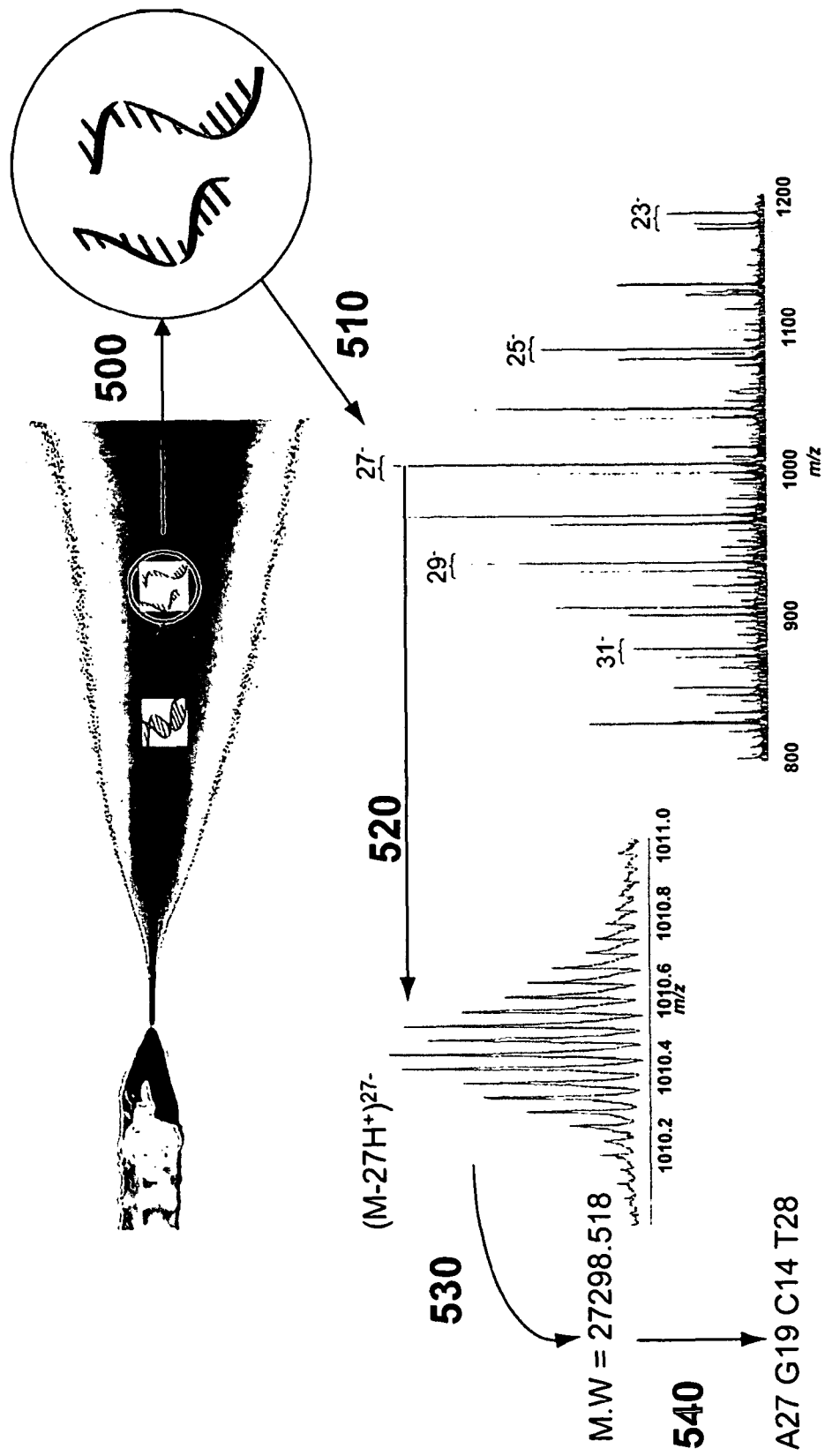

For broad-range detection of all coronaviruses, two PCR primer target regions in orf-1b, one in the RNA-dependent RNA polymerase (RdRp) and the other in Nsp11 were identified based on the analyses described in Examples 3 and 4. Locations of primers within these regions were optimized both for sensitivity and broad-range priming potential simultaneously by performing limiting dilutions of multiple, diverse coronaviruses. Analysis of the final primer pairs by ePCR of GenBank nucleotide database sequences showed that these primers would be expected to amplify all the known coronaviruses but no other viruses, bacteria, or human DNA. PCR products for each virus listed in Table 4 were generated, desalted, and analyzed by electrospray ionization Fourier transform ion cyclotron mass spectrometry (FTICR-MS) indicated in Examples 1 and 2. The spectral signals were algorithmically processed to yield base composition data. FIG. 8 is a schematic representation of electrospray ionization, strand separation, and the actual charge state distributions of the separated sense and antisense strands, and determination of molecular mass and base composition of the PCR products from the RdRp primer pair for the SARS coronavirus.

Due to the accuracy of FTICR-MS (mass measurement error±1 ppm), all detected masses could be unambiguously mapped to the base compositions of sense and antisense strands. The results from analysis of 14 coronavirus isolates are shown in Table 4.

TABLE 4

Experimentally Determined Molecular Masses and Base Compositions for a Selected Set of Coronaviruses

| Coronavirus Species | Strain | Strand | Experimentally Determined Monoisotopic Masses (RdRp) | Calculated Base Compositions (RdRp) | Experimentally Determined Monoisotopic Masses (nsp11) | Calculated Base Compositions (nsp11) |
|---|---|---|---|---|---|---|
| Canine | 1-71 | Sense | 27486.514 | A24 G24 C8 T32 | 42475.955 | A33 G31 C19 T54 |
| | | Antisense | 26936.574 | A32 G8 C24 T24 | 42185.117 | A54 G19 C31 T33 |
| Canine | CCV-TN449 | Sense | 27471.510 | A24 G24 C9 T31 | 42474.899 | A34 G30 C18 T55 |
| | | Antisense | 26952.548 | A31 G9 C24 T24 | 42184.072 | A55 G18 C30 T34 |
| Feline | WSU 79-1683 | Sense | 27471.517 | A24 G24 C9 T31 | 42490.945 | A33 G31 C18 T55 |
| | | Antisense | 26952.556 | A31 G9 C24 T24 | 42169.118 | A55 G18 C31 T33 |
| Feline | DF2 | Sense | 27472.497 | A23 G25 C10 T30 | 42450.904 | A33 G30 C19 T55 |
| | | Antisense | 26953.536 | A30 G10 C25 T23 | 42209.081 | A55 G19 C30 T33 |
| Human 229E | 229E | Sense | 27450.532 | A25 G24 C11 T28 | 42462.994 | A36 G30 C20 T51 |
| | | Antisense | 26975.545 | A28 G11 C24 T25 | 42198.061 | A51 G20 C30 T36 |
| Human 229E | 229E | Sense | 27450.506 | A25 G24 C11 T28 | 42462.930 | A36 G30 C20 T51 |
| | | Antisense | 26975.512 | A28 G11 C24 T25 | 42198.040 | A51 G20 C30 T36 |

TABLE 4-continued

Experimentally Determined Molecular Masses and Base Compositions for a Selected Set of Coronaviruses

| Corona-virus Species | Strain | Strand | Experimentally Determined Monoisotopic Masses (RdRp) | Calculated Base Compositions (RdRp) | Experimentally Determined Monoisotopic Masses (nsp11) | Calculated Base Compositions (nsp11) |
|---|---|---|---|---|---|---|
| Bovine | Calf Diarrheal virus | Sense | 27358.452 | A22 G22 C12 T32 | 42606.039 | A38 G32 C15 T52 |
| | | Antisense | 27066.586 | A32 G12 C22 T22 | 42052.897 | A52 G15 C32 T38 |
| Human OC43 | OC43 | Sense | 27328.473 | A22 G22 C14 T30 | 42580.959 | A38 G31 C15 T53 |
| | | Antisense | 27098.562 | A30 G14 C22 T22 | 42076.028 | A53 G15 C31 T38 |
| Murine Hepatiits Virus | MHV1 | Sense | 27344.491 | A21 G23 C14 T30 | 42602.022 | A37 G34 C18 T48 |
| | | Antisense | 27083.564 | A30 G14 C23 T21 | 42061.016 | A48 G18 C34 T37 |
| Murine Hepatitis Virus | JHM-thermostable | Sense | 27344.497 | A21 G23 C14 T30 | 42529.960 | A34 G34 C21 T48 |
| | | Antisense | 27083.571 | A30 G14 C23 T21 | 42136.047 | A48 G21 C34 T34 |
| Murine Hepatitis Virus | MHV-A59 | Sense | 27344.503 | A21 G23 C14 T30 | 42599.989 | A34 G35 C18 T50 |
| | | Antisense | 27083.572 | A30 G14 C23 T21 | 42064.089 | A50 G18 C35 T34 |
| Rat | 8190 | Sense | 27344.491 | A21 G23 C14 T30 | 42544.967 | A34 G34 C20 T49 |
| | | Antisense | 27083.567 | A30 G14 C23 T21 | 42120.041 | A49 G20 C34 T34 |
| SARS | TOR2 | Sense | 27298.518 | A27 G19 C14 T28 | 42519.906 | A34 G33 C20 T50 |
| | | Antisense | 27125.542 | A28 G14 C19 T27 | 42144.026 | A50 G20 C33 T34 |
| SARS | Urbani | Sense | 27298.518 | A27 G19 C14 T28 | 42519.906 | A34 G33 C20 T50 |
| | | Antisense | 27125.542 | A28 G14 C19 T27 | 42144.026 | A50 G20 C33 T34 |
| Avian Infectious Bronchitis Virus | Egg-adapted | Sense | 27396.544 | A24 G24 C14 T26 | 42530.984 | A33 G32 C17 T55 |
| | | Antisense | 27032.524 | A26 G14 C24 T24 | 42129.100 | A55 G17 C32 T33 |

For both primer regions, the measured signals agreed with compositions expected from the known coronavirus sequences in GenBank. Several of the isolates used in this study did not have a genome sequence record in GenBank. Nevertheless, bioagent identifying amplicons were obtained for all test viruses and their base compositions were experimentally determined. These experimentally determined base compositions were confirmed by sequencing. Thus the strategy described here enables identification of viruses without the need for prior knowledge of sequence.

Figure 9:
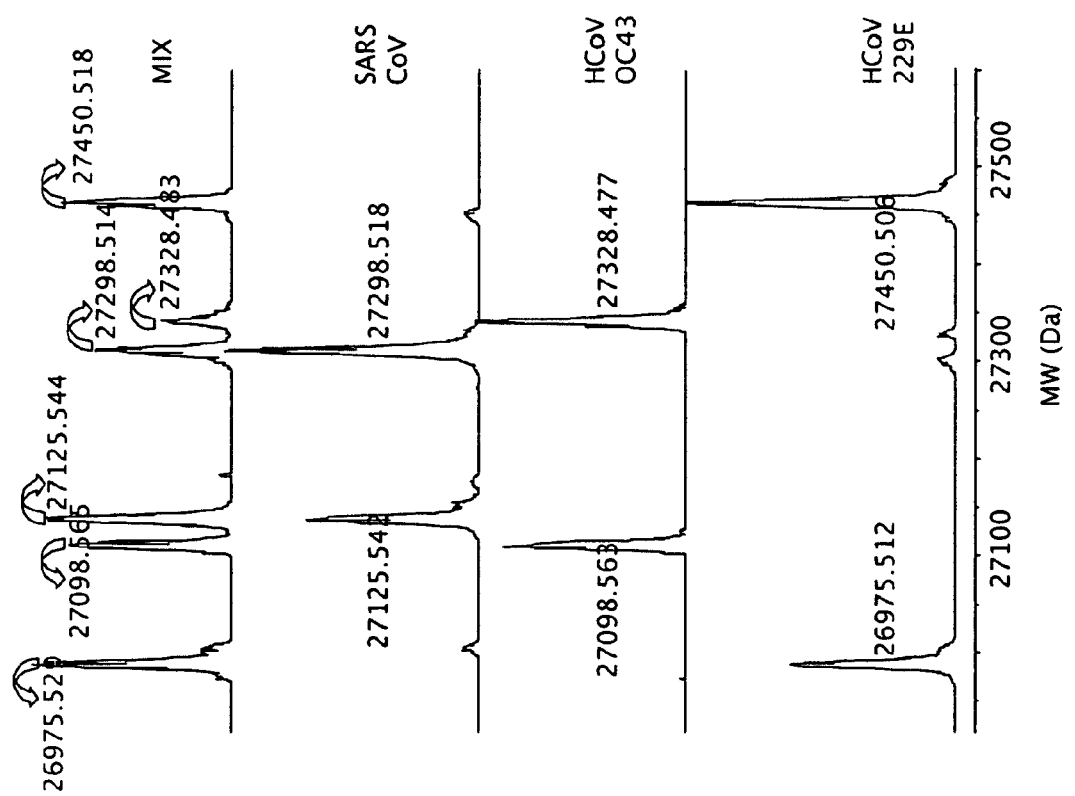

To demonstrate the potential to detect multiple viruses in the same sample, as might occur during a co-infection, viral extracts from three human coronaviruses, HCoV-229E, HCoV-OC43, and SARS CoV, were pooled and the mixture was analyzed by the methods of the present invention. Signals from all three viruses were clearly detected and resolved in the mass spectrum (FIG. 9), demonstrating that co-infections of more than one coronavirus species could be identified. Dynamic range for reliable multispecies detections in this system is $10^4$(100:1 in each direction, data not shown). This example indicates that the etiology of a coronavirus infection can be resolved using the method of the present invention. Furthermore, the method of identification of coronaviruses can be combined with general methods of broad range and drill-down identification of bacteria to resolve a more complex etiology comprising viral and bacterial co-infections.

Figure 10:
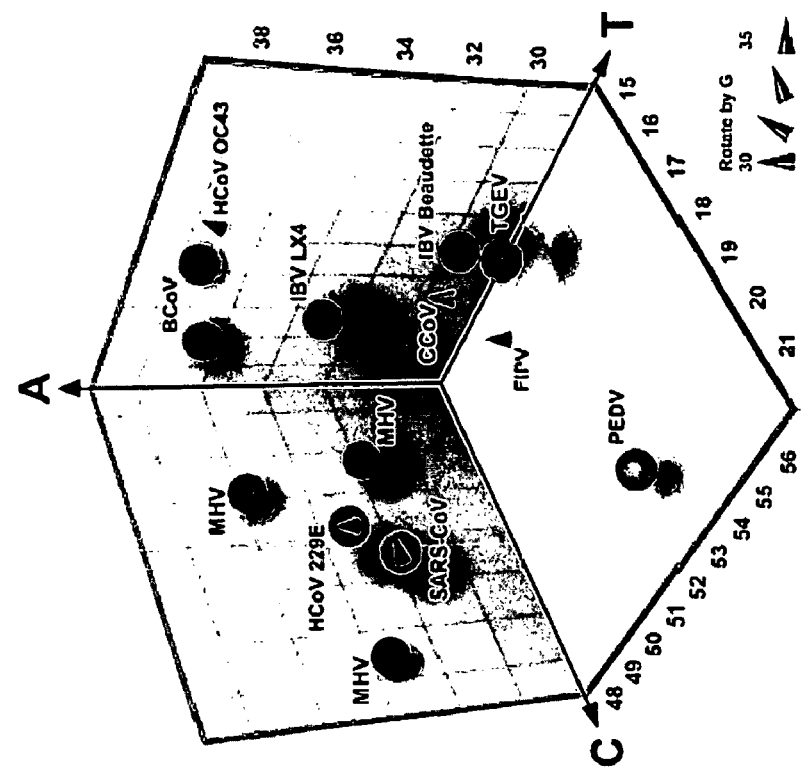
Figure 10:
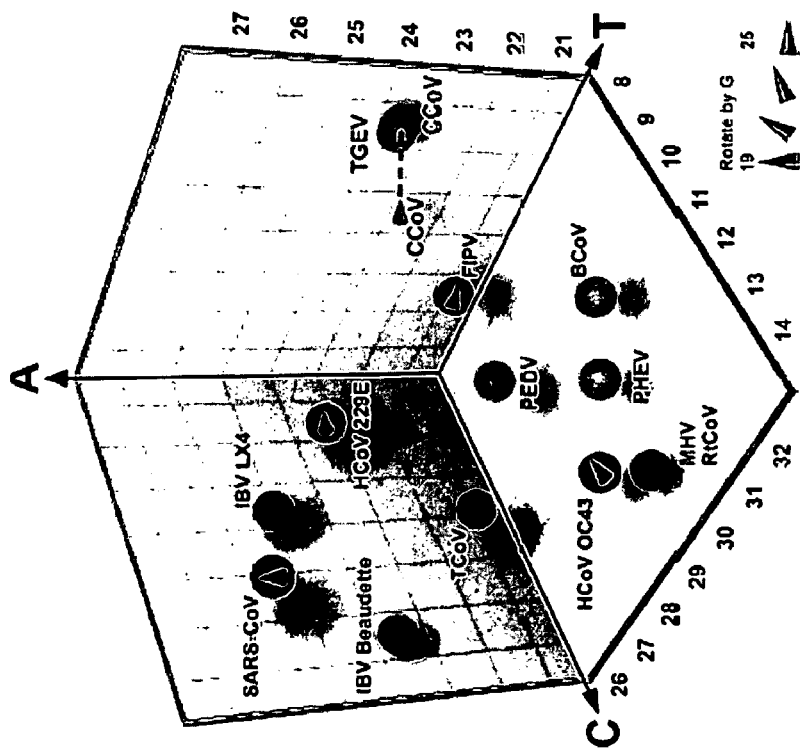

Shown in FIG. 10 is a spatial representation of the base compositions of five different coronaviruses for RdRp and nsp11 bioagent identifying amplicons. The G content of each base composition is represented by the tilt angle of the cone which indicates experimentally determined base composition. Calculated base compositions are indicated by the labeled spheres. FIG. 10 indicates that the experimentally determined base compositions generally match the calculated base compositions. One exception is the canine coronavirus analysis which indicated that a single T to C substitution (single nucleotide polymorphism) exists in the amplicon.

Characterization of a bioagent identifying amplicon does not require prior knowledge of sequence. This feature is exemplified for the bioagent identifying amplicons obtained with the nsp11 primer set. No sequence was available in the nsp11 region for three of the five viral species (FIPV, CcoV and HcoV OC43). Nevertheless, base compositions of the three bioagent identifying amplicons were determined which were well within the expected bounds of base compositions of coronavirus nsp11 bioagent identifying amplicons. Thus, had the identity of these three coronaviruses been unknown and if they had been tested with the same primer sets, they would have been identified as newly discovered coronaviruses.

Example 6

Quantitation of SARS Coronavirus by Internally Calibrated PCR

SARS coronavirus was handled in a P3 facility by investigators wearing forced air respirators. Equipment and supplies were decontaminated with 10% hypochlorite bleach solution for a minimum of 30 minutes or by immersion in 10% formalin for a minimum of 12 h and virus was handled in strict accordance with specific Scripps Research Institute policy. SARS CoV was cultured on sub confluent Vero-E6 cells at 37° C., 5% $CO_2$ in complete DMEM with final concentrations of 10% fetal bovine serum (Hyclone), 292 μg/mL L-Glutamine, 100 U/mL penicillin G sodium, 100 μg/mL streptomycin sulfate (Invitrogen), and 10 mM HEPES (Invitrogen). Virus-containing medium was collected during the peak of viral cytopathic effects, 48 h after inoculation with approximately 10 PFU/cell of SARS CoV from the second passage of stock virus. Infectious virus was titered by plaque assay. Monolayers of Vero-E6 cells were prepared at 70-80% confluence in tissue culture plates. Serial tenfold dilutions of virus were prepared in complete DMEM. Medium was aspirated from cells, replaced by 200 μL of inoculum, and cells were incubated at 37° C., 5% $CO_2$ for 1 hour. Cells were overlaid with 2-3 mL/well of 0.7% agarose, 1× DMEM overlay containing 2% fetal bovine serum. Agarose was allowed to solidify at room temperature then cells were incubated at 37° C., 5% $CO_2$ for 72 h. Plates were decontaminated by overnight formalin immersion, agarose plugs were removed, and cells were stained with 0.1% crystal violet to highlight viral plaques.

In order to demonstrate the detection of SARS coronavirus in a clinically relevant fluid, varying dilutions of the titered SARS virus were added to human serum. Serial tenfold dilutions ($10^0$ to $10^{-15}$) of the SARS virus were prepared in complete DMEM. 50 μL of each dilution of the virus was added to 200 μL human serum, mixed well and treated with 0.75 mL of Trizol Reagent LS (Invitrogen, Carlsbad, Calif.) at room temperature for 10 minutes. Contents were then transferred to a clean tube, which was sterilized on the outside with 10% bleach and moved to a P2 facility. RNA was extracted following protocols described above. 100% of the isolated RNA was reverse transcribed. 1/40th of the RT reaction was used per PCR reaction. RT-PCR was carried out as described in Example 2.

To determine the relationship between PFU and copies of nucleic acid target, the SARS coronavirus stock solution was analyzed using internally calibrated PCR. Synthetic DNA templates with nucleic acid sequence identical in all respects to each PCR target region from SARS CoV with the exception of 5 base deletions internal to each amplicon were cloned into a pCR-Blunt vector (Invitrogen, Carlsbad, Calif.). The calibrant plasmid was quantitated using $OD_{260}$ measurements, serially diluted (10-fold dilutions), and mixed with a fixed amount of post-reverse transcriptase cDNA preparation of the virus stock and analyzed by competitive PCR and electrospray mass spectrometry. Each PCR reaction produced two sets of amplicons, one corresponding to the calibrant DNA and the other to the SARS cDNA. Since the primer targets on the synthetic DNA calibrant and the viral cDNA were almost identical, it was assumed that similar PCR efficiencies exist for amplification of the two products. Analysis of the ratios of peak heights of the resultant mass spectra of the synthetic DNA and viral cDNA for each dilution of the calibrant were used to determine the amounts of nucleic acid copies (as measured by calibrant molecules) present per PFU, post reverse transcriptase. A PFU (plate forming unit) is defined as a quantitative measure of the number of infectious virus particles in a given sample, since each infectious virus particle can give rise to a single clear plaque on infection of a continuous "lawn" of bacteria or a continuous sheet of cultured cells. Since all of the extracted RNA was used in the reverse transcriptase step to produce the viral cDNA, the approximate amount of nucleic acids associated with infectious virus particles in the original viral preparation was estimated.

Figure 11:
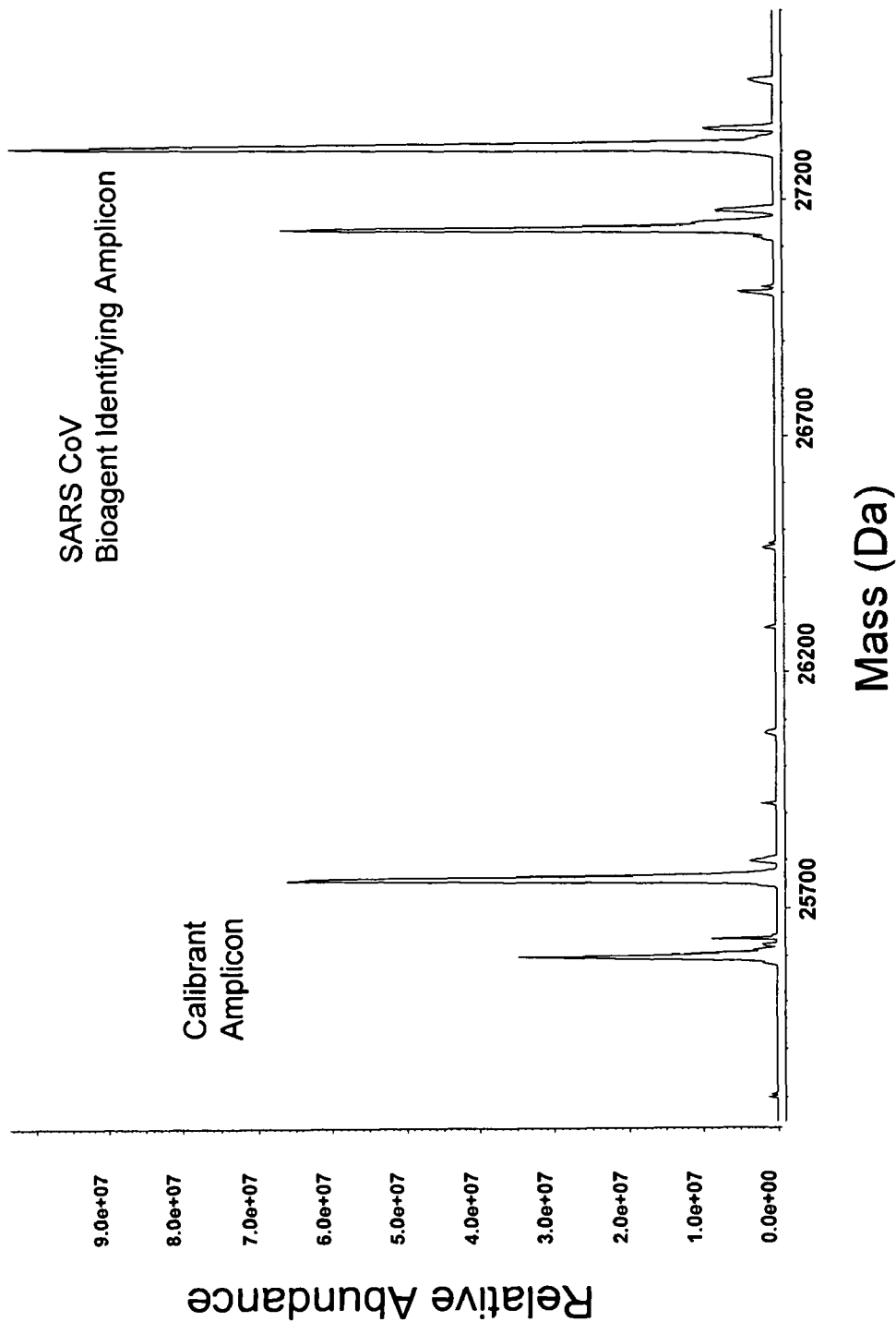

To determine the relationship between PFU and copies of nucleic acid, the virus stock was analyzed using internally calibrated PCR. Synthetic DNA templates with nucleic acid sequence identical in all respects to each PCR target region from SARS CoV with the exception of 5 base deletions internal to each amplicon were cloned into a pCR-Blunt vector (Invitrogen, Carlsbad, Calif.). The calibrant plasmid was quantitated using OD260 measurements, serially diluted (10-fold dilutions), and mixed with a fixed amount of post -reverse transcriptase cDNA preparation of the virus stock and analyzed by competitive PCR and electrospray mass spectrometry. Each PCR reaction produced two sets of amplicons, one corresponding to the calibrant DNA and the other to the SARS cDNA. Since the amplicons generated from the synthetic DNA calibrant (calibrant amplicon) and the viral cDNA (bioagent identifying amplicon) were almost identical, it was assumed that PCR efficiencies for amplification of the two products were similar. Analysis of the ratios of peak heights of the resultant mass spectra of the synthetic DNA and viral cDNA for each dilution of the calibrant were used to determine the amounts of nucleic acid copies (as measured by calibrant molecules) present per PFU, post reverse transcriptase. Since all of the extracted RNA was used in the reverse transcriptase step to produce the viral cDNA, the approximate amount of nucleic acids associated with infectious virus particles in the original viral preparation could be estimated. Mass spectrometry analysis showed an approximate 1:1 peak abundance between the calibrant peak at the $3\times10^4$ copy number dilution and the bioagent identifying amplicon peak for the RdRp primer set (Figure 11). Thus, the relationship between PFU and copies of nucleic acid was calculated to be 1 PFU =300 copies of nucleic acid.

Various modifications of the invention, in addition to those described herein, will be apparent to those skilled in the art from the foregoing decription. Such modifications are also intended to fall within the scope of the appended claims. Each of the patents, applications, printed publications, and other published documents mentioned or referred to in this specification are incorporated herein by reference in their entirety. Those skilled in the art will appreciate that numerous changes and modifications may be made without departing from the spirit of the invention. It is therefore intended that the appended claims cover all such equivalent variations as fall within the true spirit and scope of the invention.

SEQUENCE LISTING (226 sequences)

SEQ ID NO: 1 - RNA, 90 nt, Bacillus anthracis
  misc_feature 20: n = A, U, C or G
gcgaagaaccuuaccaggunuugacauccucugacaacccuagagauagggcuucuccuucgggagcagagugacagguggugcaugguu

SEQ ID NO: 2 - RNA, 90 nt, Bacillus cereus
gcgaagaaccuuaccaggucuugacauccucugaaaacccuagagauagggcuucuccuucgggagcagagugacagguggugcaugguu

SEQ ID NO: 3 - RNA, 1388 nt, Artificial Sequence
  Synthetic consensus sequence
  misc_feature 1-7, 15, 22-24, 36-38, 41, 42,44, 56, 59-90, 93, 97, 98, 109,110, 112-116, 118-120, 123-131, 134,136, 138-144, 149-155, 161,162, 164-177, 182-209, 212-220, 222-225, 227, 230, 231, 235, 236,241, 245, 246, 253, 255-257, 260, 261-263, 267, 269, 270, 278, 279,281, 282, 284, 291, 294, 301, 306, 310, 329, 330, 335, 336-338,344, 345, 347, 350, 351, 355, 356, 357, 361,363, 364, 371, 372,373, 376, 379, 382-386, 388, 389, 394-396, 398-405, 408, 411-438,442, 443, 445-451, 453, 454, 458-460, 465, 469, 491, 495, 496, 499,504-506, 511, 512, 514, 524, 526-528, 530, 534, 537-544, 546-550,552, 556-562, 565, 569-578, 580-586, 589-595, 597, 601-606, 609,612-617, 621-624, 629, 633, 636, 639, 643, 645, 646, 648, 650, 654,658-660, 669-674, 678-683, 689, 691, 693-696, 704, 708, 712, 734,737, 738, 744, 746-754, 756-758, 760-782, 784-786, 791-793,796-800, 815, 816, 823-825, 834, 845, 848, 857, 859, 864, 869, 875,877, 878, 884, 886, 894-898, 903-917, 920, 922-948, 955, 961, 972,973, 978, 990, 1005-1013, 1015, 1017, 1019, 1021-1029, 1031, 1033,1037-1043, 1049-1051, 1053, 1054, 1057-1059, 1069, 1075, 1083, 1085,1089, 1094, 1096-1099, 1104, 1110, 1111, 1119-1123, 1127, 1128,1130, 1132, 1133, 1136, 1138, 1139-1141, 1143, 1144, 1146-1150,1154, 1157, 1159-1162, 1166-1170, 1172, 1173, 1176, 1181, 1183-1186,1195-1198, 1200, 1205, 1206, 1210, 1220-1222, 1227, 1229, 1231-1233,1244, 1249, 1266-1268, 1271, 1273, 1274, 1277-1285, 1288, 1289,1293-1304, 1306-1311, 1313-1322, 1324, 1326, 1329, 1330-1338, 1341,1345-1347, 1361, 1364, 1366-1368, 1372, 1373, 1375, 1378, 1388: n = A,U,C or G
nnnnnnnagaggacnggccagnnngaacgcggcggnnngcnnanacagcaagcgancgnnnnnnnnnnnnnnnnnnnnnnnnnnnnnnnnagnggcnnacggggagaanncnnnnnannnccnnnnnnnnnggnanannnnnnngaaannnnnnnaaaccnnannnnnnnnnnnnnnaaagnnnnnnnnnnnnnnnnnnnnnnnnnnnngannnnnnnnngnnnnanagnngggnnggaanggcnnaccaagncnnngannnnagcngnncgagaggnngnncngccacanggnacgaganacggnccanacccacgggaggcagcagnnggaannnncaaggnngnaanncgannnagcnannccgcggnnnganganggnnnnngnngaaannncnnnnnnnngangannnnnnnnnnnnnnnnnnnnnnnnnnnngacnnannnnnnnannaagnnncggcnaacncggccagcagccgcggaaacgnaggnngcnagcgnnncggannangggcgaaagngnnngnaggnggnnnnnnnngnnnnngnaaannnnnnngcnaacnnnnnnnnnncnnnnnnnacnnnnnnncngagnnnnnnagnggnnnnnngaannnnggagngggnaancgnagananngnangaanaccnnngcgaaggcnnnnnncggnnnnnnacgacncnannnncgaaagcngggnagcnaacaggaagaacccggagccangcnnaaacgngnnnnnnnnngnnngnnnnnnnnnnnnnnnnnnnnnnnannnaacgnnnaannnnnccgccggggagacgnncgcaagnnnaaaccaaangaagacggggnccngcacaagcngnggagnagggnaacgangnnacgcgnanaaccaccnnnnngacannnnnnnnnnnnnnnganannnnnnnnnnnnnnnnnnnnnnnnnnnacagggngcaggngcgcagccggnnggagnggggaagcccgnaacgagcgcaacccnnnnnnnnngncnancnnnnnnnnngngnaccnnnnnnnacgccnnngnnaannnggaggaaggnggggangacgcaancncagncccangnnnngggcncacacnncacaaggnnnnnacanngngnngcnannnngnnannnnnagcnaancnnnnaaannnnncnnagncggangnnnncgcaaccgnnnncngaagnnggancgcagaacgnnnacagnangnnncgggaaacgcncgggncgacacaccgcccgcannncangnnagnnnnnnnnnccnnaagnnnnnnnnnnnncnnnnnngnnnnnnnnnncnanggnnnnnnnnnngangggnnnaagcgaacaagganccnannngaanngnggnggacaccccn

SEQ ID NO: 4 - RNA, 2654 nt, Artificial Sequence
  Synthetic consensus sequence
  misc_feature 1-4, 8-12, 16, 18-22, 31, 35-40, 43, 47, 54, 56-62, 64, 65, 67-69,71, 72, 74-76, 79, 80, 83, 84, 86-93, 95-99, 101, 104-106, 108, 109,119, 125-142, 144-171, 173-175, 178-182, 186, 194, 198-202, 208, 214,215, 218-221, 224, 226-229, 233, 244-246, 248, 250, 251, 254, 256-280,282-284, 288-292, 295, 299-307,309-311, 314, 316, 318, 319, 322, 325-328,332-354, 358-360, 362-365, 367, 370, 372, 373, 375-378, 380, 381,385-387, 389-392, 398-403, 407, 414-420, 425, 429, 431, 433, 434, 439,443, 451, 458, 463, 464, 465, 466, 467, 469, 479, 482, 483, 492-496, 498,500, 503-505, 507-509, 512-525, 528, 529, 533, 537, 539, 540, 543-545,547, 549, 552-561, 564, 567, 570-578, 580, 583, 586, 589, 594, 599-601,604, 605, 607, 611-613, 616-620, 622-625, 630, 635, 637-639, 643, 646-648,651, 652, 657, 662-666, 670, 672-676, 682, 689-696, 703-708, 714, 715,718-720, 722, 725, 730, 731, 733, 736, 738, 742-744, 746, 747, 756, 757,763-766, 770-773, 776-791, 794,805-814, 817-829, 832, 833, 835-842, 847,852, 855-870, 872, 875, 876, 878, 879, 881-883, 885, 887, 889, 892-894,896-898, 900, 901, 903, 908, 913, 920, 922, 923, 925-927, 932, 936,939-946, 952, 956, 959, 962-967, 969, 970, 972, 976-978, 983, 999, 1001,1002, 1008, 1009, 1015, 1022, 1023, 1025, 1028-1034, 1039, 1042, 1043,1045, 1047, 1052, 1056-1063, 1069-1074, 1076-1097, 1102, 1103, 1109-1121,1126-1132, 1134, 1135, 1137-1143, 1147-1155, 1159, 1161, 1164, 1165, 1167,1168, 1170, 1174, 1178-1185, 1189, 1191, 1192, 1194-1198, 1200, 1204,1206-1208, 1210, 1215, 1218-1223, 1225, 1227-1229, 1231-1236, 1240,1245-1247, 1253, 1254, 1258, 1260, 1263,1265, 1267, 1268, 1271, 1272,1277, 1278, 1280-1282, 1285, 1286, 1291-1293, 1296-1316, 1321-1326,1328-1345, 1348-1455, 1457, 1458, 1464-1490, 1496, 1497, 1511, 1513-1516,1518, 1519, 1523, 1525, 1526, 1528, 1529, 1533, 1535-1537, 1539-1542,1545-1552, 1560, 1561, 1567-1571, 1576, 1581, 1583, 1588-1591, 1593-1633,1635-1638, 1640-1642, 1644-1646, 1648-1654, 1656, 1661, 1662, 1673, 1674,1676, 1677, 1680, 1683, 1684, 1687, 1691, 1692, 1695, 1699, 1702, 1703,1707, 1714, 1718, 1719, 1727, 1728, 1730-1738, 1740-1744, 1746-1756,1758-1760, 1767, 1768, 1770, 1779, 1780, 1789, 1790, 1820, 1828, 1831,1833, 1836, 1839-1846, 1851-1859, 1861, 1863, 1865, 1869-1871, 1873-1877,1879, 1886-1890, 1892, 1896-1900, 1915, 1916, 1918, 1920, 1924, 1925,1927-1932, 1934, 1936-1950, 1952, 1953, 1956, 1961, 1966, 1968, 1969,1970, 1973-1980, 1983, 1984, 1987-1993, 1998, 2000-2004, 2006, 2007, 2011,2014, 2016-2029, 2034-2044, 2046, 2048-2056, 2061, 2063-2065, 2067, 2068,2072, 2075, 2085, 2086, 2091, 2095, 2096, 2106, 2108, 2109, 2111,2116-2118, 2120, 2122-2125, 2128, 2129, 2132, 2133, 2136-2143, 2146, 2147,2150, 2151, 2153, 2155, 2159, 2160, 2161, 2164, 2165, 2169, 21702173-2176, 2179-2182, 2190-2192, 2199, 2200, 2203-2205, 2214, 2217-2222,2228, 2232, 2248, 2251, 2253, 2266, 2268-2271, 2280, 2283, 2291-2294, 2311,2313, 2324, 2327, 2328, 2339, 2340, 2349, 2350, 2355, 2358, 2362, 2370,2372, 2386, 2394, 2396, 2397, 2399, 2401, 2403, 2405-2407, 2410-2412,2415-2417, 2419-2421, 2423, 2424, 2426, 2442-2444, 2446, 2449, 2450, 2452,2454, 2459-2461, 2463, 2466-2468, 2473-2475, 2479, 2480, 2483, 2485, 2486,2491-2494, 2497-2500, 2505, 2506, 2512, 2520-2522, 2526, 2528-2530,2532-2535, 2539, 2540, 2543-2545, 2547, 2549-2568, 2571-2573, 2575,2576-2579, 2583, 2584, 2586-2589, 2591, 2597-2599, 2601-2603, 2605,2609-2612, 2614, 2615, 2617, 2618-2622, 2625-2627, 2630-2632, 2637-2640,2642-2647, 2649-2654: n = A,U,C or G
nnnnaagnnnnnaagngnnnnnggggagccnggcnnnnnnagncgangaaggangnnnnnnncnncnnnanncnnnggnnagnngnnnnnnnncnnnnnanccnnngnnccgaaggggnaacccnnnnnnnnnnnnnnnnnnannnnnnnnnnnnnnnnnnnnnnnnnnnngnnnacnnnnngaangaaacacnagannnnnaggaanagaaannaannnngancnnnngagnggcgagcgaannngnannagncnnnnnnnnnnnnnnnnnnnnnnnnnannngaannnnnggnaagnnnnnnnnnannnggnanannccngannnnaaannnnnnnnnnnnnnnnnnnnnnnagannncnnnncncgngnnannnngnngaannngnnnngaccannnnnnaagncaaaacnnnnnnngaccnaagngnannagacngganggaaaggngaaaagnacccnnnnnangggaggaaanagnnccgaaaccnnnnncnanaannngnnnagnnnnnnnnnnnnnnganngcgnccgnannagnnncngngannnnnnnnnngcnagnaannnnnnnnngnagncgnagngaaancgagnnnaanngngcgnnnagnnnnngnnnnagacncgaancnnnggancannnagnncaggngaagnnnnngaanannnnnggaggnccgaacnnnnnnnnggaaaannnnnnggagannggnnngnggngaaanncnaancnaacnnngnnaagcggccnncgaaannnnaggnnnngcnnnnnnnnnnnnnnnnggnggagagcacgnnnnnnnnnnggnnnnnnnnnnnnnacnnannnnnnnnaaacncgaanccnnnnnnnnnnnnnnnngnagnnanncnnngngngnaannncnnngnnanagggnaacancccagancnncnnnaaggncccnaannnnnnnnaagggnaaanganggnnnnnncnnanacannnaggangggcagaagcagccancnnaaaganngcgaanagccacnncnagnnnnnnngcgcngannanancgggncaannnnnnnnccgaannnnnngnnnnnnnnnnnnnnnnnnnnnnggagnngagcgnnnnnnnnnnnnngaagnnnnnnngnnannnnnnnggannnnnnnnnaggngnagnngnnanagancgannnnnnnnggananncnnnnncnccgnannncnaaggnccnnnnnnangnnncnnnnnngggnagcgnnnccaagnngagncnganangnnagnngaggnnannnggnnaaccnnnacnnnnnnnnnnnnnnnnnnnnngacgnnnnnngnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnngaaaannnnnnnnnnnnnnnnnnnnnnnnnnncgaccnnaaaccgacacaggngnnnngnngagnanncnnaggngnnngnnnnaannnnnnnnaaggaacnngcaaannnnnccganccggnanaaggnnnncnnnnnnnnnnnnnnnnnnnnnnnnnnnnnnnnnnnnnnnnngnnnnannnannngnnnnnnncnacgannaaaaacacagnncnngcnaanncgnaagnngangaanggnngacnccgcccnggcnngaaggaanngnnnnnnnnngnnnnngnnnnnnnnnnnannnaagcccnngnaacggcggnngaacaaacnnccaaggagcgaaaccgcgggaagccgaccngcacgaanggngnaangannnnnnnncgccnnnnnnnnncncngngaannnannnnngnaagagcnnnnncncgcnnnnngacggaaagaccccnngnancacnnannnnnnangnnnnnnnnnnnnnnngnnagnaaggnggagncnnngannnnnnnncgnnagnnnnnnnggagncnnnnngnnaacnacncnnnnnnnnnnnnnncaacnnnnnnnnnnnancnnnnnnnnngacangnnngnngggnagnacggggcggnnccccnaaanngaacggaggngnncnaaggnnncnannnnggnnggnnacnnnnnnnnagnnaanngnanaagnnngcnnacgnnagnnnnacnnnncgagcagnnncgaaagnnggnnnaggaccggnggnnnnnnggaagngccncgccaacggaaaaagnacncnggggaaacaggcnannnncccaagagncanacgacggnnnngggcacccgagcggccncncaccggggcgnagnnggcccaagggnnggcgcgccnnaaagnggnacgngagcgggnanaacgcggagacagnggcccacngnngngngngnnngannngannngnnngnncnagacgagaggaccggnnngnacnnancncgggnnncnggnnngccannngcanngcngnnagcannnnggnnnngaaanngcgaangcacaagnnngaancnnncnnnnagannagnnncncnnnnnnnnnnnnnnnnnnnnagnnncnnnnnagannannnngngaaggnnngnnngnaagnnnngnnannnnnnagnnnacnnnacaannnncnnnnnncnnnnnn

SEQ ID NO: 5 - DNA, 26 bp, Artificial Sequence
  PCR PRimer
tgtttgttttggaattgtaatgttga

SEQ ID NO: 6 - DNA, 25 bp, Artificial Sequence
  PCR PRimer
tggaatgcatgcttattaacataca

SEQ ID NO: 7 - DNA, 21 bp, Artificial Sequence
  PCR PRimer
taagttttatggcgggtggga

SEQ ID NO: 8 - DNA, 21 bp, Artificial Sequence
  PCR PRimer
tttagggtagtcccaacccat

SEQ ID NO: 9 - DNA, 19 bp, Artificial Sequence
  PCR PRimer
taagttttatggcgggtgg

SEQ ID NO: 10 - DNA, 21 bp, Artificial Sequence
  PCR PRimer
tttaggatagtcccaacccat

SEQ ID NO: 11 - DNA, 19 bp, Artificial Sequence
  PCR PRimer
taagttttatggcggctgg

SEQ ID NO: 12 - DNA, 9081 bp, Coronavirus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatctcccaaaccacgggatgtcattcttgtgtccaaagacatccctgaacaactttgtgacgctttgtttttctatacgtcacataaccctaaggattacgctgatgcttttgcagttaggcagaagtttgaccgtagtctccagactgggaaacagttcaaatttgaaactgtgtgtggtctcttcctcttgagggagttgacaaaataacacctggcgtcccagcaaaagttttaaaagccacttctaagttggcagatttagaagacatctttggtgtctctcctttagcgcggaagtaccgtgaattgttgaaaacagcgtgtcagtggtctcttactgtagaagcactggatgttcgtgcacaaactctcgatgaaatttttgaccccactgaaatactttggcttcaggtggctgcaaaaattcatgtttcatctatggcaatgcgcaggcttgttggagaagtaactgcaaaagtcatggatgctctgggctcaaacttgagtgctctttttcaaattgttaaacaacaaatagccagaatctttcaaaaggcactggctatttttgagaatcgagcctttgatgtttgtaataaggaatcagctggtatgtttcaaaatttgaagcgtaactgcgctagattccaggaactacgcgatactgaagatggaaatcttgagtatcttgattcttactttgtagttaaacaaaccactcctagtaattatgaacatgaaaaatcttgttacgaagacttaaagtcagaagtaacagctgaccatgacttctttgtgttcaataagaacatttacaatattagtaggcaacggcttactaaatatactatgatggacttctgctatgctttgagacatttcgacccaaaggattgtgaagttcttaaagaaatacttgtcacttatggttgtatagaagactatcaccctaagtggtttgaggagaataaggattggtacgacccaatagaaaactcaaaatattatgtcatgttggctaaaatgggacctattgtacgacgtgctttattgaatgctattgagttcggaaaccttatggttgaaaaaggttatgttggtgttattacactcgataaccaagaccttaatggcaaattttatgattttggtgattttcagaagacggcacctggtgctggtgttcctgtttttgatacgtattattcttacatgatgcccatcatagccatgacggatgctttagcacctgagaggtactttgaatatgatgtgcacaagggttataaatcttatgatctcctcaagtatgattatactgaggagaaacaagaattgtttcagaagtactttaagtactgggatcaagagtatcatcctaactgccgtgactgtagtgatgacaggtgtttgatacattgtgcaaacttcaatatcttgttttctacacttataccgcagacttctttcggtaatttgtgtagaaaagtttttgttgatggtgtaccatttatagctacttgtggctatcattctaaggaacttggtgttattatgaatcaagataacaccatgtctttttcaaaaatgggtttaagtcaactcatgcagtttgttggagatcctgctttgttagtgggaacatccaataatttagttgatcttagaacgtcttgttttagtgtttgtgcgttaacatctggtattactcatcaaacggtaaagccaggtcactttaacaaggatttctatgattttgcagagaaggctggtatgtttaaggagggttcgtctataccacttaaacattttttctatcctcaaactggtaatgctgctataaacgattatgattattatcgttataacaggcctaccatgtttgacatatgtcaacttctattttgtttagaagtgacttctaaatactttgagtgttatgaaggcggctgtataccagctagccaagttgtagttaacaacttagataagagtgcaggctatccatttaataagtttggaaaagcccgcctctattatgaaatgagtctagaggaacaggaccaactcttcgagattacgaagaagaatgtcctacccactataactcaaatgaatttaaaatatgccatatccgcgaaaaatagagcgcgtacagtggcaggtgtgtctatcctttctactatgactaataggcagtttcatcagaagattcttaagtctatagtcaacactagaaatgcttctgtagttattggaacaaccaagttttatggcggttgggacaacatgttgagaaacctgattcagggtgttgaagacccaattcttatgggttgggattatcctaagtgtgatagagcaatgcctaatttgttgcgtatagcagcatccttagtacttgctcgcaaacacactaactgttgtagttggtctgaacgcatttataggttgtataatgaatgcgcccaggtcttatctgaaactgtacttgctacaggtggtatttatgttaaacctggtggcactagcagtggtgatgctactactgcttatgcaaacagtgtttttaacataatacaagccacatctgctaatgttgcgcgtcttttgagtgttataacgcgtgatattgtctatgataatattaagagcttgcagtatgaattgtatcagcaggtctacaggcgagttaattttgacccagcctttgttgaaaagttttattcttacttatgtaagaatttttcgttgatgatcttgtctgacgacggtgttgtttgttacaacaacacattagccaaacaaggtcttgtagcagatatttctggttttagagaggttctctactatcagaataatgtttttatggctgattctaaatgttgggttgaaccagatttagaaaaaggcccacatgagttttgttcacaacacacaatgctagtggaggttgatggtgagcctaagtatttgccatacccagacccttcacgcattttgggtgcatgtgtttttgtagatgacgtggataagacagaacctgtggctgttatggagcgttatatagctcttgccatagatgcttatccactagtacatcatgaaaatgaagagtacaagaaggtattctttgttctccttgcatatatcagaaaactctatcaagagctttctcagaatatgcttatggactactcttttgtaatggatatagacaagggtagtaaattttgggaacaggagttctatgagaatatgtatagagctcctacgactttacaatcttgtggcgtttgtgtagtttgtaatagtcaaactatactacgctgcggtaattgtattcgtaaaccgtttttgtgttgtaagtgttgctatgaccacgtcatgcatacggaccacaaaaatgttttatctataaatccttatatttgctcacagctaggttgcggtgaagcagatgttactaaattgtacctcgggggtatgtcgtacttctgtggtaatcataaaccgaaattgtcaataccgttagtatctaatggtactgtttttggaatttacagggctaattgtgctggtagtgaaaatgttgatgattttaatcaactagctactactaattggtccattgtcgaaccttatattttagcaaatcgctgtagtgattcattgagacgttttgctgcagagacagtaaaagccacagaagaattacataagcaacaatttgctagtgcagaagtgcgagaagtattctcagatcgtgaattgattctatcatgggaaccaggaaaaaccaggccgccattgaatagaaattatgttttcacaggttatcactttacaagaactagtaaggtgcagcttggtgattttacatttgaaaaaggtgaaggtaaggatgttgtctattataaagcaacgtctactgctaaattgtctgtaggagacatttttgttttaacctcacacaatgttgtttctctcgtagcgccaacattgtgtccacaacaaaccttttctaggtttgtaaatttaagacctaatgtaatggtacctgaatgttttgtaaataacattccactttaccatttagtaggtaaacagaagcgtactacagtacaaggtcctcctggcagtggtaaatcccactttgctataggccttgcagtatactttagtagcgctcgtgttgtttttactgcatgttctcatgcagctgttgatgctttatgtgaaaaagcttttaagtttcttaaagttgatgattgcactcgtatagtaccccaaaggactactgtcgattgcttctcaaaatttaaagctaatgacacaggcaaaaagtacatttttagtactattaatgccttgccggaagttagttgtgatattcttttggttgacgaggttagtatgttgaccaattacgaattgtcctttattaatggtaagataaattaccaatatgttgtgtatgtaggtgatccggctcaattaccggcaccccgcactttacttaatggttcactttctccaaaggattataatgttgtcacaaaccttatggtttgtgttaaacctgatattttccttgcaaagtgttatcgttgtcctaaggaaattgtagacactgtgtctactcttgtttatgatggaaagtttattgcaaataacccagaatcacgtgagtgtttcaaggttatagttaataatggcaattctgatgtaggacatgaaagtggttcagcctacaacacaacacaattggaatttgtgaaagactttgtttgtcgcaataaacaatggcgggaagcaatatttatttcaccttacaatgctatgaaccagagagcttaccgtatgcttggacttaatgttcaaacagtagattcttctcaaggttcagagtatgattatgtcatcttctgtgttactgcagattcgcagcatgcactgaatattaatagatttaatgtggcgcttacaagagctaagcgtggtatactagttgtcatgcgccagcgtgatgaattgtattctgctcttaagtttacagagctagatagtgaaacaagtctgcaaggtacaggtttgtttaaaatttgcaacaaagaatttagtggtgtccatcctgcttatgcagtcacaactaaggctcttgctgcaacctataaagttaatgatgaacttgctgcacttgttaatgtggaagctggttcagaaataacatataaacatcttatttctctgttaggattcaagatgagtgttaatgttgaaggctgccacaacatgtttataacacgtgatgaggcaatccgcaatgtaagaggttgggtaggttttgatgtagaagcaacacatgcttgtggcactaacattggtactaacctgccttttcaagtaggtttctctactggtgcagactttgtagtcacgcctgagggacttgtagatacttcaataggcaataattttgagcctgtgaattctaaagcacctccaggtgaacaatttaaccacttgagagtgttatttaaaagtgctaaaccttggcatgttataagaccaaggatagtgcagatgttagcagacaatctatgcaacgtttcagattgtgtagtgtttgtcacatggtgtcatggcctagaactaactactttgcgctattttgttaaaataggcaaggaacaagtttgttcttgtggttctagagctacaacttttaattctcatactcaagcttatgcttgttggaagcattgtttgggttttgattttgtttataacccacttctagtggatattcaacagtggggttactcgggtaacctacagtttaatcatgatttgcactgtaatgtgcatggccacgctcatgtagcttctgttgacgctataatgactcgttgtcttgcaattaacaatgcattttgtcaagatgtcaactgggatttgacataccctcacattgcaaatgaggatgaagtcaattctagttgtagatatctacaacgcatgtatcttaatgcgtgtgttgatgctcttaaagttaatgttgtctatgatataggcaaccctaaaggtattaaatgtgttaggcgtggggatgttaattttagattctatgataagaatccaatagtacgcaacgtcaagcagtttgagtatgactataatcagcacaaagataagtttgctgatggtctttgtatgttttggaattgtaatgtggattgttatcctgataattccttggtttgtaggtatgacacacgaaatttgagtgtgtttaacctaccaggctgtaatggtggtagtctgtacgttaacaaacatgcattctacacacctaaatttgaccgcattagcttccgcaatttgaaagctatgccattctttttttatgactcatcgccttgtgaaaccattcaagtggatggagttgcgcaagaccttgtgtctctagctacgaaagactgtatcacaaagtgcaacattggtggcgctgtttgtaagaaacatgcccagatgtatgcagaatttgtgacttcttacaatgcagctgtcacagctggctttactttctgggtaactaataaacttaacccttataacttatggaaaagtttttcagctctccagtctatcgacaatattgcttataatatgtataagggtggtcattatgatgctattgctggagaaatgcccactgtcataactggagacaaagtttttgttattgatcaaggtgtagaaaaggcagtttttgttaatcaaacaactctacctacatctgtggcgtttgagctatatgcaaagagaaatattcgcacactgccaaacaaccgtattttgaaaggtttaggtgtagacgtaaccaatggatttgagcaataaaagccaagaagttaaatacacctccgcccaagtttgaaggtagcggtgttcctgataacgaaaacattaagccaagccagcaacatggatactggagacgccaagccaggtttaagccaggcaaaggtggaagaaaaccagtcccagatgcttggtacttttactatactggaacaggacctgccgctgacctgaactggggtgatactcaagatggtatagtgtgggttgctgctaagggtgctgatactaaatctagatccaatcagggtacaagagatcctgataagtttgaccaatacccactacgattctcggatggcggacctgatggtaatttccgttgggacttcattcccctgaaccgtggtaggagtggaagatcaacagcagcttcatcagcagcagctagtagagcaccatcacgtgaaggttcgcgtggtcgtagaagtgattctggagatgaccttattgctcgtgcagcaaagataatccaggatcagcagaaaaagggctctcgcattaccaaggcaaaggcagatgaaatggctcatcgccggtattgcaagcgcactatcccacctaattatagggttgatcaagtgtttggtccccgtactaaaggtaaggaggggaattttggtgatgacaagatgaatgaggaaggtattaaggatgggcgtgttacagcaatgctcaacctagtccctagcagccatgcttgtctttttggaagtagagtgacacccaaacttcaactagatgggcttcacttgagatttgaatttactactgtggtcccatgtgatgacccgcagtttgataattatgtgaaaatttgtgatcagtgtgtcgatggtgtaggaacgcgtccaaaagatgacgaaccaaaaccaaagtcacgctcaagttcaagacctgctacaagaggaaattctccagcgccaagacaacagcgcccaaagaaggagaaaaagctaaagaagcaggatgatgaagcagataaagcattgacctcagatgaggagaggaacaatgcacagctggaattttatgatgagcccaaggtaattaactggggggatgcagctctaggagagaatgaactttgagtaacataatggacctgttgtttcctggtacattttgttaaacactatttctgtgctttcctatcaattattacaggcattgattgtgattatgttcaatacttaagcttcttttggttgctttttgcttattgtattgttgctgtgctttttattgttgtgattctcattagtttgctttatcgtagaaattcaatagtaagagttaaggaagataggcatgtagcttgattacctacatgtctatcgccagggaaatgtctaatctgtctacttagtagcctggaaacgaacggtagacccttagattttaatttagtttaatttttagtttagtttaagttagtttagagtaggtataaagatgccagtgccggggccacgcggagtacgatcgagggtacagcactaggacgcccattaggggaagagctaaattttagtttaagttaagtttaattggctaagtatagttaaaatttataggctagtatagagttagagca

SEQ ID NO: 13 - DNA, 6127 bp, Coronavirus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatctcccaaaccacgggatgtcattcttgtgtccaaagacatccctgaacaactttgtgacgctttgtttttctatacgtcacataaccctaaggattacgctgatgcttttgcagttaggcagaagtttgaccgtagtctccagactgggaaacagttcaaatttgaaactgtgtgtggtctcttcctcttgagggagttgacaaaataacacctggcgtcccagcaaaagttttaaaagccacttctaagttggcagatttagaagacatctttggtgtctctcctttagcgcggaagtaccgtgaattgttgaaaacagcgtgtcagtggtctcttactgtagaagcactggatgttcgtgcacaaactctcgatgaaatttttgaccccactgaaatactttggcttcaggtggctgcaaaaattcatgtttcatctatggcaatgcgcaggcttgttggagaagtaactgcaaaagtcatggatgctctgggctcaaacttgagtgctctttttcaaattgttaaacaacaaatagccagaatctttcaaaaggcactggctatttttgagaatcgagcctttgatgtttgtaataaggaatcagctggtatgtttcaaaatttgaagcgtaactgcgctagattccaggaactacgcgatactgaagatggaaatcttgagtatcttgattcttactttgtagttaaacaaaccactcctagtaattatgaacatgaaaaatcttgttacgaagacttaaagtcagaagtaacagctgaccatgacttctttgtgttcaataagaacatttacaatattagtaggcaacggcttactaaatatactatgatggacttctgctatgctttgagacatttcgacccaaaggattgtgaagttcttaaagaaatacttgtcacttatggttgtatagaagactatcaccctaagtggtttgaggagaataaggattggtacgacccaatagaaaactcaaaatattatgtcatgttggctaaaatgggacctattgtacgacgtgctttattgaatgctattgagttcggaaaccttatggttgaaaaaggttatgttggtgttattacactcgataaccaagaccttaatggcaaattttatgattttggtgattttcagaagacggcacctggtgctggtgttcctgtttttgatacgtattattcttacatgatgcccatcatagccatgacggatgctttagcacctgagaggtactttgaatatgatgtgcacaagggttataaatcttatgatctcctcaagtatgattatactgaggagaaacaagaattgtttcagaagtactttaagtactgggatcaagagtatcatcctaactgccgtgactgtagtgatgacaggtgtttgatacattgtgcaaacttcaatatcttgttttctacacttataccgcagacttctttcggtaatttgtgtagaaaagtttttgttgatggtgtaccatttatagctacttgtggctatcattctaaggaacttggtgttattatgaatcaagataacaccatgtctttttcaaaaatgggtttaagtcaactcatgcagtttgttggagatcctgctttgttagtgggaacatccaataatttagttgatcttagaacgtcttgttttagtgtttgtgcgttaacatctggtattactcatcaaacggtaaagccaggtcactttaacaaggatttctatgattttgcagagaaggctggtatgtttaaggagggttcgtctataccacttaaacattttttctatcctcaaactggtaatgctgctataaacgattatgattattatcgttataacaggcctaccatgtttgacatatgtcaacttctattttgtttagaagtgacttctaaatactttgagtgttatgaaggcggctgtataccagctagccaagttgtagttaacaacttagataagagtgcaggctatccatttaataagtttggaaaagcccgcctctattatgaaatgagtctagaggaacaggaccaactcttcgagattacgaagaagaatgtcctacccactataactcaaatgaatttaaaatatgccatatccgcgaaaaatagagcgcgtacagtggcaggtgtgtctatcctttctactatgactaataggcagtttcatcagaagattcttaagtctatagtcaacactagaaatgcttctgtagttattggaacaaccaagttttatggcggttgggacaacatgttgagaaacctgattcagggtgttgaagacccaattcttatgggttgggattatcctaagtgtgatagagcaatgcctaatttgttgcgtatagcagcatccttagtacttgctcgcaaacacactaactgttgtagttggtctgaacgcatttataggttgtataatgaatgcgcccaggtcttatctgaaactgtacttgctacaggtggtatttatgttaaacctggtggcactagcagtggtgatgctactactgcttatgcaaacagtgtttttaacataatacaagccacatctgctaatgttgcgcgtcttttgagtgttataacgcgtgatattgtctatgataatattaagagcttgcagtatgaattgtatcagcaggtctacaggcgagttaattttgacccagcctttgttgaaaagttttattcttacttatgtaagaatttttcgttgatgatcttgtctgacgacggtgttgtttgttacaacaacacattagccaaacaaggtcttgtagcagatatttctggttttagagaggttctctactatcagaataatgtttttatggctgattctaaatgttgggttgaaccagatttagaaaaaggcccacatgagttttgttcacaacacacaatgctagtggaggttgatggtgagcctaagtatttgccatacccagacccttcacgcattttgggtgcatgtgtttttgtagatgacgtggataagacagaacctgtggctgttatggagcgttatatagctcttgccatagatgcttatccactagtacatcatgaaaatgaagagtacaagaaggtattctttgttctccttgcatatatcagaaaactctatcaagagctttctcagaatatgcttatggactactcttttgtaatggatatagacaagggtagtaaattttgggaacaggagttctatgagaatatgtatagagctcctacgactttacaatcttgtggcgtttgtgtagtttgtaatagtcaaactatactacgctgcggtaattgtattcgtaaaccgtttttgtgttgtaagtgttgctatgaccacgtcatgcattctacacacctaaatttgaccgcattagcttccgcaatttgaaagctatgccattctttttttatgactcatcgccttgtgaaaccattcaagtggatggagttgcgcaagaccttgtgtctctagctacgaaagactgtatcacaaagtgcaacattggtggcgctgtttgtaagaaacatgcccagatgtatgcagaatttgtgacttcttacaatgcagctgtcacagctggctttactttctgggtaactaataaacttaacccttataacttatggaaaagtttttcagctctccagtctatcgacaatattgcttataatatgtataagggtggtcattatgatgctattgctggagaaatgcccactgtcataactggagacaaagtttttgttattgatcaaggtgtagaaaaggcagtttttgttaatcaaacaactctacctacatctgtggcgtttgagctatatgcaaagagaaatattcgcacactgccaaacaaccgtattttgaaaggtttaggtgtagacgtaaccaatggatttgagcaataaaagccaagaagttaaatacacctccgcccaagtttgaaggtagcggtgttcctgataacgaaaacattaagccaagccagcaacatggatactggagacgccaagccaggtttaagccaggcaaaggtggaagaaaaccagtcccagatgcttggtacttttactatactggaacaggacctgccgctgacctgaactggggtgatactcaagatggtatagtgtgggttgctgctaagggtgctgatactaaatctagatccaatcagggtacaagagatcctgataagtttgaccaatacccactacgattctcggatggcggacctgatggtaatttccgttgggacttcattcccctgaaccgtggtaggagtggaagatcaacagcagcttcatcagcagcagctagtagagcaccatcacgtgaaggttcgcgtggtcgtagaagtgattctggagatgaccttattgctcgtgcagcaaagataatccaggatcagcagaaaaagggctctcgcattaccaaggcaaaggcagatgaaatggctcatcgccggtattgcaagcgcactatcccacctaattatagggttgatcaagtgtttggtccccgtactaaaggtaaggaggggaattttggtgatgacaagatgaatgaggaaggtattaaggatgggcgtgttacagcaatgctcaacctagtccctagcagccatgcttgtctttttggaagtagagtgacacccaaacttcaactagatgggcttcacttgagatttgaatttactactgtggtcccatgtgatgacccgcagtttgataattatgtgaaaatttgtgatcagtgtgtcgatggtgtaggaacgcgtccaaaagatgacgaaccaaaaccaaagtcacgctcaagttcaagacctgctacaagaggaaattctccagcgccaagacaacagcgcccaaagaaggagaaaaagctaaagaagcaggatgatgaagcagataaagcattgacctcagatgaggagaggaacaatgcacagctggaattttatgatgagcccaaggtaattaactggggggatgcagctctaggagagaatgaactttgagtaacataatggacctgttgtttcctggtacattttgttaaacactatttctgtgctttcctatcaattattacaggcattgattgtgattatgttcaatacttaagcttcttttggttgctttttgcttattgtattgttgctgtgctttttattgttgtgattctcattagtttgctttatcgtagaaattcaatagtaagagttaaggaagataggcatgtagcttgattacctacatgtctatcgccagggaaatgtctaatctgtctacttagtagcctggaaacgaacggtagacccttagattttaatttagtttaatttttagtttagtttaagttagtttagagtaggtataaagatgccagtgccggggccacgcggagtacgatcgagggtacagcactaggacgcccattaggggaagagctaaattttagtttaagttaagtttaattggctaagtatagttaaaatttataggctagtatagagttagagc

SEQ ID NO: 14 - DNA, 27608 bp, Coronavirus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatctcccaaaccacgggatgtcattcttgtgtccaaagacatccctgaacaactttgtgacgctttgtttttctatacgtcacataaccctaaggattacgctgatgcttttgcagttaggcagaagtttgaccgtagtctccagactgggaaacagttcaaatttgaaactgtgtgtggtctcttcctcttgaagggagttgacaaaataacacctggcgtcccagcaaaagttttaaaagccacttctaagttggcagatttagaagacatctttggtgtctctcctttagcgcggaagtaccgtgaattgttgaaaacagcgtgtcagtggtctcttactgtagaagcactggatgttcgtgcacaaactctcgatgaaatttttgaccccactgaaatactttggcttcaggtggctgcaaaaattcatgtttcatctatggcaatgcgcaggcttgttggagaagtaactgcaaaagtcatggatgctctgggctcaaacttgagtgctctttttcaaattgttaaacaacaaatagccagaatctttcaaaaggcactggctatttttgagaatgtgaatgaattaccacagcgtattgcagcacttaagatggcttttgccaagtgtgctaggtcaattactgttgtggttgttgaaagaactctagttgttaaagagttcgcaggaacttgtcttgcaagcattaatggtgctgtcgcaaaattctttgaagagttgccaaacggcttcatgggttctaagattttcacaacacttgccttctttaaagaggcagctgtgagagttgtggagaacataccaaatgcaccgagaggtactaagggatttgaagttgttggcaatgccaaaggcacacaggtagttgtgcgcggcatgcgaaatgacttaacattgcttgaccaaaaagctgatattcctgttgaaccagaaggttggtctgcaattttggatggacatctttgctatgtctttaggagtggtgatcgcttttatgctgcacctctttcaggaaattttgctttgagtgatgttcattgctgtgagcgtgtagtctgtctatctgatggtgtaacaccggagataaatgatggactcattctagctgcaatctactcttcttttagtgtctctgagcttgtaacagctcttaaaaagggtgaaccattcaagttcttgggccataaattcgtgtatgcgaaggatgcagcagtgtcttttactttagcgaaggctgccactattgcagatgtcttgaggctgtttcaatcagctcgtgtgatagcagaagatgtttggtcttcatttactgaaaagtcttttgaattctggaagcttgcatatggaaaagtgcgcaaccttgaagaatttgtgaagacctatgtttgtaaggctcaaatgtcgattgtgattctagcagcagtgcttggagaggacatttggcatcttgtctcacaagtcatctataaattaggtgttctttttactaaagtcgttgacttttgtgacaaacactggaaaggtttttgtgtacagttgaaaagagctaagctcattgtcaccgaaaccttctgtgttttaaaaggagttgcacagcattgttttcaactgctgctagatgcaatacactctttgtacaagagttttaagaagtgtgcacttggtagaatccatggagatttgctcttctggaaaggaggtgtgcataaaattgttcaagatggcgatgaaatatggtttgacgccattgatagtgttgatgttgaagatctgggtgttgttcaggaaaaatcgattgattttgaggtttgcgatgacgtgacacttccagaaaaccaacctggtcatatggttcaaatagaggatgatggtaagaactacatgttcttccgttttaaaaaggatgagaacatttattatacaccaatgtctcaacttggtgctattaatgtggtttgcaaagcaggcggtaagactgtcacctttggagaaactacagtacaagagataccaccacctgatgtcgtgcctattaaggttagcatagaatgttgtggtgaaccatggaatacgatcttcaagaaggcttataaagagcctatagaagtagatacagacctcacagtagaacaattgctctctgtgatctatgagaaaatgtgtgacgaccttaaattgtttccagaggcaccagagcctccaccatttgagaatgtcgcacttgttgataagaacggtaaagatttggattgtataaaatcttgccatttgatctatcgtgactatgagagcgatgatgacatcgaggaggaagatgctgaggagtgtgacacagactcaggtgaagctgaggagtgtgacactaattcagaatgtgaagaagaggatgaggatactaaagtgttggctcttatacaagacccggcaagtattaaataccctctgcctcttgatgaagattatagcgtctataatggatgtattgtacacaaggacgctcttgatgttgtgaatttaccatctggtgaagaaacttttgttgtcaataactgttttgagggagctgttaaaccacttccacagaaggtagttgatgttcttggtgactggggagaggctgttgatgcgcaagaacaactgtgtcaacaagagcctctgcaacatacctttgaagaaccagtcgaaaattctactggtagttctaagacaatgactgaacaagtcgttgtagaagatcaagaactacctgttgttgaacaagatcaggatgtagttgtttatacacctacagatcttgaagttgcaaaagaaacagcagaagaggttgatgagtttattctcatttttgctgttcctaaagaagaagttgtgtcccagaaagatggggcacagattaaacaagagcctattcaagttgttaaaccacaacgtgagaagaaggctaaaaagttcaaagttaaaccagccacatgtgagaaacctaaatttttggagtataaaacatgtgtgggtgatttgactgttgtaattgccaaagcattggatgagtttaaagagttctgcattgtaaatgctgcaaatgagcatatgactcatggtagtggcgttgcaaaggcaattgcagacttttgtggactggattttgttgaatattgtgaggactatgttaagaaacatgggccacaacagagacttgttacaccttcgtttgtcaaaggcattcaatgtgtgaataatgttgtaggaccccgccatggagacaacaacttgcatgagaagcttgttgctgcctacaagaatgtgcttgtagatggcgtagtcaattatgttgtgccagttctttcattaggaatttttggtgtagattttaaaatgtcaatagacgcaatgcgtgaagcttttgaaggttgcaccatacgcgttcttttgttttctctgagccaagaacacatcgattatttcgatgtaacttgcaaacagaagacaatttatcttacggaggatggtgttaaataccgctccattgttctaaaacctggtgactcattgggtcaatttggacaggtttatgctaaaaacaagatagtttttacagccgatgatgttgaggacaaagaaattctctacgtccccacgactgataaaagcattcttgaatactatggtttagatgcgcaaaagtatgtaatatatttgcaaacgcttgcgcagaaatggaatgtccaatatagggacaattttcttatactagagtggcgcgatggaaattgttggattagttcagcaatagttctccttcaagctgctaaaattaggtttaaaggttttctaacagaagcgtgggctaaactgttaggtggagatcctacagactttgttgcctggtgttatgcaagttgtactgctaaagtaggtgatttctcagatgctaattggcttttagcgaatttagcagaacattttgacgcagattacacaaatgcgtttcttaagaagcgcgtttcgtgtaactgtggtattaagagctatgagcttagaggccttgaagcttgtattcagccagttcgggcaactaatctgctacattttaagacgcaatattcaaattgcccaacctgtggcgcaaataatacggatgaagtaatagaagcttcgttaccgtacttattgctttttgctactgatggtcctgctacagttgattgtgatgaagatgctgtggggactgtcgtgtttgttggttctactaatagtggccattgttatacacaagctgcagggcaagcttttgataatcttgctaaagatagaaaatttggaaagaagtcgccttacattactgcaatgtatacgcgattcgcttttaagaatgaaacctctttgcctgttgctaaacagagcaagggtaagtctaagtcggtaaaggaagatgtttctaaccttgctactagttctaaggccagttttgataatcttactgacttcgaacagtggtatgatagtaacatctatgaaagtcttaaagtgcaggaatcacctgataactttgataaatatgtgtcattcacaacaaaggaagattctaagttgccattgacacttaaggttagaggtattaaatcagttgttgactttagatcgaaggatggttttatttataagttaacacctgatactgatgaaaattcaaaagcaccagtctactacccagtcttggacgctattagtcttaaggcaatatgggtggaaggtaatgctaactttgttgttggtcatccaaattattatagtaagtctcttcatattcctactttttgggaaaatgctgagaattttgttaaaatgggtgataaaattggtggtgtaactatgggactttggcgtgcagaacaccttaataaacctaatttggagagaattttcaacattgctaagaaagccattgttggatctagtgttgttactacacaatgcggtaaattaataggtaaagcagctacattcattgctgataaagtaggtggtggtgtagttcgcaatattacagatagcattaagggtctttgtggaattacacgagggcattttgaaagaaaaatgtctccacaattcctaaagacgcttatgttctttttattctatttcttgaaggctagtgttaagagtgttgtcgctagctataagaccgtgttatgtaaggtggtacttgctactttacttatagtttggtttgtctacacaagtaacccagtaatgtttacaggaatacgtgtgttagattttctattcgagggttctttgtgtggtccttataaagactatggtaaagattcttttgatgtgttacgatattgtgcagatgattttatttgtcgtgtgtgtttacatgacaaagattcacttcatttgtacaaacacgcttatagtgtagagcaggtctataaagatgcagcttctggttttatttttaattggaattggctttatttggtctttctaatattatttgttaaaccagtggcaggttttgttattatttgctattgtgttaagtatttggtattgaattcaactgtgctgcaaactggtgtttgttttttagattggtttgtacaaacagtttttagtcactttaattttatgggagcagggttttatttctggctcttttacaagatatatatacaggtgcatcatatactgtattgtaaggatgtaacatgtgaagtgtgcaaaagggttgcacgcagcaacaggcaagaggttagcgtggttgttggtggacgcaagcagatagtgcatgtttacactaactctggctataacttttgtaagagacataattggtattgtagaaattgtgatgattatggtcaccaaaatacatttatgtctcctgaagttgctggcgagctctctgaaaagcttaagcgccatgttaaacctacagcatacgcttaccacgttgtggatgaggcatgcttagttgatgattttgtcaatttaaaatataaagctgcaactcctggtaaggatagtgcatcttcagctgttaagtgtttcagtgttacagatttcttgaagaaagctgtttttcttaaggaagcactgaaatgtgaacaaatatctaatgatggttttatagtgtgtaatacacagagtgctcatgcattagaggaagcaaagaatgcagccatctattatgcgcaatatctgtgtaagccaatacttatacttgaccaggcactttatgagcaattagtagtagagcctgtgtctaagagtgttatagataaagtgtgtagcattttgtctagtataatatctgtagatactgcagctttaaattataaggcaggcacacttcgtgatgctctgctttctattactaaagacgaagaggccgtagatatggctatattctgtcataatcatgatgtggattacactggtgatggttttactaatgtgataccgtcatatggtatagacactggcaagttaacacctcgtgatagagggtttttgataaatgcagatgcttctattgctaacttaagagttaaaaatgctccgccggtagtatggaagttttctgagcttattaagttgtctgacagttgtcttaaatatttaatttcggctactgttaagtcaggtgttcgtttctttataacaaagtctggtgctaaacaagttattgcttgtcatacacagaagttgttagtagagaaaaaggcaggtggtattgttagcggcacctttaagtgttttaagagttattttaaatggctcttgatcttttacatactttttacagcatgttgttcgggttattactatatggaggtgagtaaaagttttgttcaccccatgtatgatgtaaactccacactgcatgttgaaggttttaaagttatagataaaggtgttcttagggaaattgtaccagaagatacatgtttctctaataaatttgttaattttgatgctttttggggcagaccatatgataatagtagaaactgtccaattgtcacagctgttatagatggtgatgggacagtagctacaggtgttcctggttttgtgtcctgggttatggatggtgttatgtttatacatatgacacagactgagagaaaaccgtggtacattcctacttggtttaatagagaaattgtcggttacactcaggattcaattattactgagggtagtttttatacatctatagcgttattttccgctaggtgtttatatttaacagccagcaatacacctcaattgtattgctttaatggtgataatgatgcacctggggctttgccatttggtagtattattcctcatagagtttatttccaacccaatggtgttaggcttatagttccacaacaaatactgcacacaccctacgtagtaaagtttgtatcagacagctattgtaggggtagtgtgtgtgagtacactagaccaggttactgtgtgtcattaaacccacaatgggttttgtttaatgacgaatacacaagtaaacccggtgttttctgtggttctactgttagagaacttatgtttagtatggttagtacattctttactggtgttaaccccaatatctatatgcaattagcaactatgtttttaatactagttgttgttgtattaatctttgcaatggttataaagtttcaaggtgtttttaaagcttatgcaaccactgtttttataacaatgttagtttgggtaattaacgcatttattttgtgtgtacatagttacaacagtgttttagctgttatattactagtactctattgctatgcgtcattggttacaagtcgcaatactgttataataatgcattgttggcttgtttttacctttggtttaatagtacccacatggttggcttgttgctacctgggatttattatttatatgtatacaccgttgtttttatggtgttatggtactacaaaaaacactcgtaagctgtatgatggcaatgagtttgttggtaattatgatcttgctgcgaagagcacttttgttattcgcggctctgaatttgttaagcttactaatgagataggtgataaatttgaggcctacctttcagcgtatgctagattaaagtactattcaggcactggcagtgaacaagattatttgcaagcttgtcgtgcatggttagcttatgctttggaccaatatagaaatagtggtgtggaaattgtttatactccgccacgttactctattggtgttagtagattacaatctggttttaagaaactggtttctcctagtagtgctgttgaaaagtgcattgttagtgtctcttatagaggtaataatcttaatggactgtggctaggtgacactatctactgtcctcgtcatgtattgggtaagttttcaggtgaccaatggaatgatgtacttaatcttgctaataatcatgagtttgaagttacaactcaacatggtgttactttgaatgttgtcagtaggcgtttaaaaggtgcagttttaattttacaaactgctgttgctaatgctgaaactccaaagtataagtttattaaagctaattgtggtgatagtttcactatagcttgtgcttatggtggtacagttgtaggactctaccctgttactatgcgttctaatggtactattagagcatcttttcttgcgggagcctgtggttcagttggttttaatatagaaaagggtgtagttaatttcttttatatgcaccatcttgagttacctaatgcattacacactggaactgacctaatgggtgaattctatggtggttatgttgatgaagaggttgcacaaagagtgccaccagataatttagttactaacaatattgtagcatggctctatgcggcaattattagtgttaaggagagtagtttctcgctgcctaaatggttggagagtactactgttagtgttgatgattataataagtgggctggtgacaatggttttacaccattttctactagtaccgctattactaaattaagtgctataactggagttgatgtttgtaagctccttcgcactattatggtaaaaaatagccagtggggtggtgaccccattttagggcaatataattttgaagatgaattgacaccggagtctgtatttaatcagattggtggtgttagattacaatcttcttttgtaagaaaagctacatcttggttttggagtagatgtgtgttagcttgcttcttatttgtgttgtgtgctattgtcttgtttacggcagtgccacttaaattttatgtatatgcagctgttattttgttaatggctgtactttttatttcttttactgttaaacatgttatggcatatatggatacttttctattgccaacattgattacagttattattggagtttgtgctgaagtgcctttcatctacaatactctaattagtcaagttgttattttcttaagtcaatggtatgacccagtagtctttgatactatggtaccatggatgttcttgccactagtgttgtatactgcttttaagtgtgtacaaggttgctatatgaattctttcaatacttctttgttaatgctgtatcagtttgtgaagttaggttttgttatttacacctcttctaatactcttactgcatacacagaaggtaattgggagttattcttcgagttggtgcacactactgtgttggctaatgttagtagtaattctttaattggtttatttgtttttaagtgtgctaaatggatgttgtattattgtaatgcaacatacttaaacaattatgtactaatggcagttatggttaactgcattggctggctctgcacttgttactttgggttgtattggtgggttaataaggtttttggtttaaccttaggtaaatacaattttaaagtttcagtagatcaatataggtatatgtgtttgcacaagataaacccacctaaaactgtgtgggaagtcttttcgacaaatatacttatacaaggaattggtggtgaccgtgtgttgcctattgctacagttcaagctaaattgagtgatgtaaagtgtacaactgttgttttaatgcagcttttgactaagcttaatgttgaagcaaattcaaaaatgcatgtttatcttgttgagttacacaataaaattcttgcttctgatgatgttggagagtgcatggataatttgttgggtatgcttataacactattttgtatagattctactattgatttgagtgagtattgtgatgacatacttaagaggtcaactgtattacaatcggttactcaagaattctcacatataccctcttatgctgaatatgaaagggctaagaatctttatgaaaaggttttagttgattctaaaaatggtggtgttacacagcaagagcttgctgcatatcgtaaagctgccaatattgcaaagtcagtttttgatagagacttggctgtccaaaagaagttagatagcatggcagagcgtgctatgacaacaatgtataaagaggcgcgtgtaacagatagacgagcaaaattagtctcatcactacatgcgttacttttctcaatgcttaagaaaatagattctgaaaagcttaatgtcttgtttgaccaggctagtagtggtgttgtgcccctagcgactgttccaattgtttgtagtaataagcttacacttgtaataccagacccagaaacgtgggtcaagtgtgtggaaggtgtgcatgttacatattcaacagttgtttggaatatagacactgttattgatgccgatggcacagagttacacccaacttctacaggtagtggattgacatactgtataagtggtgctaatatagcatggcctttaaaggttaacttgactaggaatgggcataataaggttgatgttgttttgcaaaataatgagcttatgccacatggtgttaaaacaaaggcttgcgtagcaggtgtagatcaagcacattgtagcgtagagtctaaatgttattatacaaatattagtggcaattcagttgtagctgctattacttcttcaaatccaaatctgaaagtagcttcgtttttgaatgaggcaggcaatcagatttatgtagacttagacccaccatgtaaatttggcatgaaagtgggtgtcaaggttgaggttgtttacttgtattttataaagaatacaaggtcgattgttaggggtatggtacttggtgctatatctaatgttgttgtcttacagtctaaagggcatgaaacagaggaagtggatgctgttggcattctttcactatgttcatttgcagtagatcccgcggacacatattgtaaatatgtggcagcaggtaatcaacctttaggtaactgtgttaaaatgttgacagtgcataatggtagtggttttgctataacttcaaagccaagtcctactcctgaccaggattcttatggaggagcttctgtgtgtctctattgtagagcacacatagcacatccaggaagtgtaggaaatttagatggacgttgtcaatttaaaggttcttttgtgcaaatacctactacggagaaagaccccgttggattctgtctacgtaataaggtttgcactgtttgccagtgttggattggttatggatgtcagtgtgattcacttagacaaccaaaatcttctgttcaatcagttgctggagcatctgattttgataagaattatttaaacgggtacggggtagcagtgaggctcggctgataccccttgctagtggatgtgatcctgatgttgtaaagcgagcctttgatgtttgtaataaggaatcagctggtatgtttcaaaatttgaagcgtaactgcgctagattccaggaactacgcgatactgaagatggaaatcttgagtatcttgattcttactttgtagttaaacaaaccactcctagtaattatgaacatgaaaaatcttgttacgaagacttaaagtcagaagtaacagctgaccatgacttctttgtgttcaataagaacatttacaatattagtaggcaacggcttactaaatatactatgatggacttctgctatgctttgagacatttcgacccaaaggattgtgaagttcttaaagaaatacttgtcacttatggttgtatagaagactatcaccctaagtggtttgaggagaataaggattggtacgacccaatagaaaactcaaaatattatgtcatgttggctaaaatgggacctattgtacgacgtgctttattgaatgctattgagttcggaaaccttatggttgaaaaaggttatgttggtgttattacactcgataaccaagaccttaatggcaaattttatgattttggtgattttcagaagacggcacctggtgctggtgttcctgtttttgatacgtattattcttacatgatgcccatcatagccatgacggatgctttagcacctgagaggtactttgaatatgatgtgcacaagggttataaatcttatgatctcctcaagtatgattatactgaggagaaacaagaattgtttcagaagtactttaagtactgggatcaagagtatcatcctaactgccgtgactgtagtgatgacaggtgtttgatacattgtgcaaacttcaatatcttgttttctacacttataccgcagacttctttcggtaatttgtgtagaaaagtttttgttgatggtgtaccatttatagctacttgtggctatcattctaaggaacttggtgttattatgaatcaagataacaccatgtctttttcaaaaatgggtttaagtcaactcatgcagtttgttggagatcctgctttgttagtgggaacatccaataatttagttgatcttagaacgtcttgttttagtgtttgtgcgttaacatctggtattactcatcaaacggtaaagccaggtcactttaacaaggatttctatgattttgcagagaaggctggtatgtttaaggagggttcgtctataccacttaaacattttttctatcctcaaactggtaatgctgctataaacgattatgattattatcgttataacaggcctaccatgtttgacatatgtcaacttctattttgtttagaagtgacttctaaatactttgagtgttatgaaggcggctgtataccagctagccaagttgtagttaacaacttagataagagtgcaggctatccatttaataagtttggaaaagcccgcctctattatgaaatgagtctagaggaacaggaccaactcttcgagattacgaagaagaatgtcctacccactataactcaaatgaatttaaaatatgccatatccgcgaaaaatagagcgcgtacagtggcaggtgtgtctatcctttctactatgactaataggcagtttcatcagaagattcttaagtctatagtcaacactagaaatgcttctgtagttattggaacaaccaagttttatggcggttgggacaacatgttgagaaacctgattcagggtgttgaagacccaattcttatgggttgggattatcctaagtgtgatagagcaatgcctaatttgttgcgtatagcagcatccttagtacttgctcgcaaacacactaactgttgtagttggtctgaacgcatttataggttgtataatgaatgcgcccaggtcttatctgaaactgtacttgctacaggtggtatttatgttaaacctggtggcactagcagtggtgatgctactactgcttatgcaaacagtgtttttaacataatacaagccacatctgctaatgttgcgcgtcttttgagtgttataacgcgtgatattgtctatgataatattaagagcttgcagtatgaattgtatcagcaggtctacaggcgagttaattttgacccagcctttgttgaaaagttttattcttacttatgtaagaatttttcgttgatgatcttgtctgacgacggtgttgtttgttacaacaacacattagccaaacaaggtcttgtagcagatatttctggttttagagaggttctctactatcagaataatgtttttatggctgattctaaatgttgggttgaaccagatttagaaaaaggcccacatgagttttgttcacaacacacaatgctagtggaggttgatggtgagcctaagtatttgccatacccagacccttcacgcattttgggtgcatgtgtttttgtagatgacgtggataagacagaacctgtggctgttatggagcgttatatagctcttgccatagatgcttatccactagtacatcatgaaaatgaagagtacaagaaggtattctttgttctccttgcatatatcagaaaactctatcaagagctttctcagaatatgcttatggactactcttttgtaatggatatagacaagggtagtaaattttgggaacaggagttctatgagaatatgtatagagctcctacgactttacaatcttgtggcgtttgtgtagtttgtaatagtcaaactatactacgctgcggtaattgtattcgtaaaccgtttttgtgttgtaagtgttgctatgaccacgtcatgcatacggaccacaaaaatgttttatctataaatccttatatttgctcacagctaggttgcggtgaagcagatgttactaaattgtacctcgggggtatgtcgtacttctgtggtaatcataaaccgaaattgtcaataccgttagtatctaatggtactgtttttggaatttacagggctaattgtgctggtagtgaaaatgttgatgattttaatcaactagctactactaattggtccattgtcgaaccttatattttagcaaatcgctgtagtgattcattgagacgttttgctgcagagacagtaaaagccacagaagaattacataagcaacaatttgctagtgcagaagtgcgagaagtattctcagatcgtgaattgattctatcatgggaaccaggaaaaaccaggccgccattgaatagaaattatgttttcacaggttatcactttacaagaactagtaaggtgcagcttggtgattttacatttgaaaaaggtgaaggtaaggatgttgtctattataaagcaacgtctactgctaaattgtctgtaggagacatttttgttttaacctcacacaatgttgtttctctcgtagcgccaacattgtgtccacaacaaaccttttctaggtttgtaaatttaagacctaatgtaatggtacctgaatgttttgtaaataacattccactttaccatttagtaggtaaacagaagcgtactacagtacaaggtcctcctggcagtggtaaatcccactttgctataggccttgcagtatactttagtagcgctcgtgttgtttttactgcatgttctcatgcagctgttgatgctttatgtgaaaaagcttttaagtttcttaaagttgatgattgcactcgtatagtaccccaaaggactactgtcgattgcttctcaaaatttaaagctaatgacacaggcaaaaagtacatttttagtactattaatgccttgccggaagttagttgtgatattcttttggttgacgaggttagtatgttgaccaattacgaattgtcctttattaatggtaagataaattaccaatatgttgtgtatgtaggtgatccggctcaattaccggcaccccgcactttacttaatggttcactttctccaaaggattataatgttgtcacaaaccttatggtttgtgttaaacctgatattttccttgcaaagtgttatcgttgtcctaaggaaattgtagacactgtgtctactcttgtttatgatggaaagtttattgcaaataacccagaatcacgtgagtgtttcaaggttatagttaataatggcaattctgatgtaggacatgaaagtggttcagcctacaacacaacacaattggaatttgtgaaagactttgtttgtcgcaataaacaatggcgggaagcaatatttatttcaccttacaatgctatgaaccagagagcttaccgtatgcttggacttaatgttcaaacagtagattcttctcaaggttcagagtatgattatgtcatcttctgtgttactgcagattcgcagcatgcactgaatattaatagatttaatgtggcgcttacaagagctaagcgtggtatactagttgtcatgcgccagcgtgatgaattgtattctgctcttaagtttacagagctagatagtgaaacaagtctgcaaggtacaggtttgtttaaaatttgcaacaaagaatttagtggtgtccatcctgcttatgcagtcacaactaaggctcttgctgcaacctataaagttaatgatgaacttgctgcacttgttaatgtggaagctggttcagaaataacatataaacatcttatttctctgttaggattcaagatgagtgttaatgttgaaggctgccacaacatgtttataacacgtgatgaggcaatccgcaatgtaagaggttgggtaggttttgatgtagaagcaacacatgcttgtggcactaacattggtactaacctgccttttcaagtaggtttctctactggtgcagactttgtagtcacgcctgagggacttgtagatacttcaataggcaataattttgagcctgtgaattctaaagcacctccaggtgaacaatttaaccacttgagagtgttatttaaaagtgctaaaccttggcatgttataagaccaaggatagtgcagatgttagcagacaatctatgcaacgtttcagattgtgtagtgtttgtcacatggtgtcatggcctagaactaactactttgcgctattttgttaaaataggcaaggaacaagtttgttcttgtggttctagagctacaacttttaattctcatactcaagcttatgcttgttggaagcattgtttgggttttgattttgtttataacccacttctagtggatattcaacagtggggttactcgggtaacctacagtttaatcatgatttgcactgtaatgtgcatggccacgctcatgtagcttctgttgacgctataatgactcgttgtcttgcaattaacaatgcattttgtcaagatgtcaactgggatttgacataccctcacattgcaaatgaggatgaagtcaattctagttgtagatatctacaacgcatgtatcttaatgcgtgtgttgatgctcttaaagttaatgttgtctatgatataggcaaccctaaaggtattaaatgtgttaggcgtggggatgttaattttagattctatgataagaatccaatagtacgcaacgtcaagcagtttgagtatgactataatcagcacaaagataagtttgctgatggtctttgtatgttttggaattgtaatgtggattgttatcctgataattccttggtttgtaggtatgacacacgaaatttgagtgtgtttaacctaccaggctgtaatggtggtagtctgtacgttaacaaacatgcattctacacacctaaatttgaccgcattagcttccgcaatttgaaagctatgccattctttttttatgactcatcgccttgtgaaaccattcaagtggatggagttgcgcaagaccttgtgtctctagctacgaaagactgtatcacaaagtgcaacattggtggcgctgtttgtaagaaacatgcccagatgtatgcagaatttgtgacttcttacaatgcagctgtcacagctggctttactttctgggtaactaataaacttaacccttataacttatggaaaagtttttcagctctccagtctatcgacaatattgcttataatatgtataagggtggtcattatgatgctattgctggagaaatgcccactgtcataactggagacaaagtttttgttattgatcaaggtgtagaaaaggcagtttttgttaatcaaacaactctacctacatctgtggcgtttgagctatatgcaaagagaaatattcgcacactgccaaacaaccgtattttgaaaggtttaggtgtagacgtaaccaatggatttgtaatttgggattatgctaaccaaacaccattgtatcgtaataccgtcaaggtatgtgcatatacagatattgagccaaatggcctagtagttctgtatgatgatagatatggtgattaccagtcttttcttgctgctgataatgctgttctagtttctacacagtgttataagcgatattcatacgtagaaataccatctaatttgctcgttcagaatggtatgccattaaaagatggagcgaacctgtatgtttataagcgtgttaatggtgcgtttgttacactacctaacacaataaacacccagggtcgaagttatgaaacttttgaacctcgtagtgacattgagcgtgattttctcgctatgtcagaggagagttttgtagaaaggtatggtaaagacttaggcctacaacacatactgtatggtgaagttgataagccccaattaggtggtttacacactgttataggtatgtacagactcttacgtgcgaataagttgaacgcaaagtctgtaactaattcggattctgatgtcatgcaaaattactttgtattgtcggacaatggttcttacaagcaagtgtgtactgttgtggatttactgcttgatgatttcttagaacttcttagaaacatacttaaggagtatggtactaataagtcaaaagttgtaacagtgtcaattgattaccatagcataaattttatgacttggtttgaagatggcagtattaaaacatgttatccacagcttcaatcagcatggacgtgtggttataatatgcctgaactttataaagttcagaattgtgttatggaaccttgcaacattcctaattatggtgttggaataacgttgcctagcggtattcttatgaatgtggcaaagtatacacaactttgtcaatacctttcgaaaacaacaatttgtgtaccgcataacatgcgagtaatgcatttcggagcaggaagcgacaaaggagtggcgccaggtagtactgttcttaaacaatggctcccagaagggacactccttgtcgataatgatattgtagactatgtgtctgatgcacatgtttctgtgctttcagattgcaataaatataatacagagcacaagtttgatcttgtgatatctgatatgtatacagataatgattcaaaaagaaagcatgaaggcgtgatagccaataatggcaatgatgacgttttcatatatctctcaagttttcttcgtaacaatttggctctaggtggtagttttgctgtaaaagtgacagagacaagttggcacgaagttttatatgacattgcacaggattgtgcatggtggacaatgttttgtacagcagtgaatgcctcttcttcagaagcattcttgattggtgttaattatttgggtgcaagtgaaaaggttaaggttagtggaaaaacgctgcacgcaaattatatattttggaggaattgtaattatttacaaacctctgcttatagtatatttgacgttgctaagtttgatttgagattgaaagcaacgccagttgttaatttgaaaactgaacaaaagacagacttagtctttaatttaattaagtgtggtaagttactggtaagagatgttggtaacacctcttttactagtgactcttttgtgtgcactatgtagtgctgttttgtatgacagtagttcttacgtttactactaccaaagtgccttcagaccacctagtggttggcatttacaagggggtgcttatgcggtagttaacatttctagcgaatttaataatgcaggctcttcatcagggtgtactgttggtattattcatggtggtcgtgttgttaatgcttcttctatagctatgacggcaccgtcatcaggtatggcttggtctagcagtcagttttgtactgcacactgtaatttttcagatactacagtgtttgttacacattgttataaacatggtgggtgtcctttaactggcatgcttcaacagaatcttatacgtgtttctgctatgaaaaatggccagcttttctataatttaacagttagtgtagctaagtaccctacttttagatcatttcagtgtgttaataatttaacatccgtatatttaaatggtgatcttgtttacacctctaatgagaccatagatgttacatctgcaggtgtttattttaaagctggtggacctataacttataaagttatgagagaagttaaagccctggcttattttgttaatggtactgcacaagatgttattttgtgtgatggatcacctagaggcttgttagcatgccagtataatactggcaatttttcagatggcttttatccttttactaatagtagtttagttaagcagaagtttattgtctatcgtgaaaatagtgttaatactacttgtacgttacacaatttcatttttcataatgagactggcgccaaccctaatcctagtggtgttcagaatattcaaacttaccaaacaaaaacagctcagagtggttattataattttaatttttcctttctgagtagttttgtttataaggagtctaattttatgtatggatcttatcacccaagttgtaaatttagactagaaactattaataatggcttgtggtttaattcactttcagtttcaattgcttacggtcctcttcaaggtggttgcaagcaatctgtctttaaaggtagagcaacttgttgttatgcttattcatatggaggtccttcgctgtgtaaaggtgtttattcaggtgagttagatcataattttgaatgtggactgttagtttatgttactaagagcggtggctctcgtatacaaacagccactgaaccgccagttataactcaaaacaattataataatattactttaaatacttgtgttgattataatatatatggcagaactggccaaggttttattactaatgtgaccgactcagctgttagttataattatctagcagacgcaggtttggctattttagatacatctggttccatagacatctttgttgtacaaggtgaatatggtcttaattattataaggttaacccttgcgaagatgtcaaccagcagtttgtagtttctggtggtaaattagtaggtattcttacttcacgtaatgagactggttctcagcttcttgagaaccagttttacatcaaaatcactaatggaacacgtcgttttagacgttctattactgaaaatgttgcaaattgcccttatgttagttatggtaagttttgtataaaacctgatggctcaattgccacaatagtaccaaaacaattggaacagtttgtggcacctttatttaatgttactgaaaatgtgctcatacctaacagtttcaacttaactgttacagatgagtacatacaaacgcgtatggataaggtccaaattaattgcctgcagtatgtttgtggcagttctctggattgtagaaagttgtttcaacaatatgggcctgtttgcgacaacatattgtctgtagtaaatagtgttggtcaaaaagaagatatggaacttttgaatttctattcttctactaaaccggctggttttaatacaccagttcttagtaatgttagcactggtgagtttaatatttctcttctgttaacaaatcctagtagtcgtagaaagcgttctcttattgaagaccttctatttacaagcgttgaatctgttggactaccaacaaatgacgcatataaaaattgcactgcaggacctttaggcttttttaaggaccttgcgtgtgctcgtgaatataatggtttgcttgtgttgcctcctatcataacagcagaaatgcaagctttgtatactagttctctagtagcttctatggcttttggtggtattactgcagctggtgctataccttttgccacacaactgcaggctagaattaatcacttgggtattacccagtcacttttgttgaagaatcaagaaaaaattgctgcttcctttaataaggccattggtcatatgcaggaaggttttagaagtacatctctagcattacaacaaattcaagatgttgttagtaaacagagtgctattcttactgagactatggcatcacttaataaaaattttggtgctatttcttctgtgattcaagaaatctaccagcaatttgacgccatacaagcaaatgctcaagtggatcgtcttataactggtagattgtcatcactttctgttttagcatctgctaagcaggcggagtatattagagtgtcacaacagcgtgagttagctactcagaaaattaatgagtgtgttaagtcacagtctattaggtactccttttgtggtaatggacgacatgttctaaccataccgcaaaatgcacctaatggtatagtgtttatacacttttcttatactccagatagttttgttaatgttactgcaatagtgggtttttgtgtaaagccagctaatgctagtcagtatgcaatagtgcccgctaatggtaggggtatttttatacaagttaatggtagttactacatcactgcacgagatatgtatatgccaagagctattactgcaggagatgtagttacgcttacttcttgtcaagcaaattatgtaagtgtaaataagaccgtcattactacattcgtagacaatgatgattttgattttaatgacgaattgtcaaaatggtggaatgatactaagcatgagctaccagactttgacaaattcaattacacagtacctatacttgacattgatagtgaaattgatcgtattcaaggcgttatacagggtcttaatgactctctaatagaccttgaaaaactttcaatactcaaaacttatattaagtggccttggtatgtgtggttagccatagcttttgccactattatcttcatcttaatactaggatgggttttcttcatgactggttgttgtggttgttgttgtggatgctttggcattatgcctctaatgagtaagtgtggtaagaaatcttcttattacacgacttttgataacgatgtggtaactgaacaatacagacctaaaaagtctgtttgatgatccaaagtcccacgtccttcctaatagtattaattcttctttggtgtaaacttgtactaagttgttttagagagtttattatagcgctccaacaactaatacaagttttactccaaattatcaatagtaacttacagtctagactgaccctttggcacagtctagactaatgttaaacttagaagtaattattgaaactggtgagcaagtgattcaaaaaatcagtttcaatttacagcatatttcaagtgtattaaacacagaagtatttgatccctttgactattgttattacagaggaggtaatttttgggaaatagagtcagctgaagattgttcaggtgatgatgaatttattgaataagtcgctagaggagaatggaagttttctaacagcgctttacataattgtaggatttttagcactttatcttctaggtagagcacttcaagcatttgtacaggctgctgatgcttgttgtttattttggtatacatgggtagtaattccaggagctaagggtacagcctttgtatacaagtatacatatggtagaaaacttaacaatccggaattagaagcagttattgttaacgagtttcctaagaacggttggaataataaaaatccagcaaattttcaagatgcccaacgagacaaattgtactcttgactttgaacagtcagttcagctttttaaagagtataatttatttataactgcattcttgttgttcttaaccataatacttcagtatggctatgcaacaagaagtaaggttatttatacactgaaaatgatagtgttatggtgcttttggccccttaacattgcagtaggtgtaatttcatgtacatacccaccaaacacaggaggtcttgtcgcagcgataatacttacagtgtttgcgtgtctgtcttttgtaggttattggatccagagtattagactctttaagcggtgtaggtcatggtggtcatttaatccagaatctaatgccgtaggttcaatactcctaactaatggtcaacaatgtaattttgctatagagagtgtgccaatggtgctttctccaattataaagaatggtgttctttattgtgagggtcagtggcttgctaagtgtgaaccagaccacttgcctaaagatatatttgtttgtacaccggatagacgtaatatctaccgtatggtgcagaaatatactggtgaccaaagcggaaataagaaaaggtttgctacgtttgtctatgcaaagcagtcagtagatactggcgagctagaaagtgtagcaacaggaggaagtagtctttacacataaatgtgtgtgtgtagagagtatttaaaattattctttaatagcgcctctgttttaagagcgcataagagtatttattttgaggatactaatataaatcctctttgttttatactctcctttcaagagctattaacggtgttacctttcaagtagataatggaaaagtctactacgaaggaacaccagttttccaaaaaggttgttgtaggatgtggtccaattataagaaagaataattgaaccacctactacacttatttttataagaggtgttttacttaacaaaaacttaacaaatacggacgatgaaatggctgactagttttggaagagcagttatttcttgttataaatccctactattaactcaacttagagtgttagataggttaattttagatcacggactactacgcgttttaacgtgtagtaggcgcgtgcttttagttcaattagatttagtttataggttggcgtatacgcccacccaatcgctggcatgaataatagtaaagataatccttttcgcggagcaatagcaagaaaagctcgaatttatctgagagaaggattagattgtgtttactttcttaacaaagcaggacaagcagagccttgtcccgcgtgtacctctctagtattccaagggaaaacttgtgaggaacacatacataataataatcttttgtcatggcaagcggtaaagcagctggaaaaacagacgccccagcgccagtcattaaactaggaggaccaaaaccacctaaagtcggttcttctggaaatgcatcttggtttcaagcaataaaagccaagaagttaaatacacctccgcccaagtttgaaggtagcggtgttcctgataacgaaaacattaagccaagccagcaacatggatactggagacgccaagccaggtttaagccaggcaaaggtggaagaaaaccagtcccagatgcttggtacttttactatactggaacaggacctgccgctgacctgaactggggtgatactcaagatggtatagtgtgggttgctgctaagggtgctgatactaaatctagatccaatcagggtacaagagatcctgataagtttgaccaatacccactacgattctcggatggcggacctgatggtaatttccgttgggacttcattcccctgaaccgtggtaggagtggaagatcaacagcagcttcatcagcagcagctagtagagcaccatcacgtgaaggttcgcgtggtcgtagaagtgattctggagatgaccttattgctcgtgcagcaaagataatccaggatcagcagaaaaagggctctcgcattaccaaggcaaaggcagatgaaatggctcatcgccggtattgcaagcgcactatcccacctaattatagggttgatcaagtgtttggtccccgtactaaaggtaaggaggggaattttggtgatgacaagatgaatgaggaaggtattaaggatgggcgtgttacagcaatgctcaacctagtccctagcagccatgcttgtctttttggaagtagagtgacacccaaacttcaactagatgggcttcacttgagatttgaatttactactgtggtcccatgtgatgacccgcagtttgataattatgtgaaaatttgtgatcagtgtgtcgatggtgtaggaacgcgtccaaaagatgacgaaccaaaaccaaagtcacgctcaagttcaagacctgctacaagaggaaattctccagcgccaagacaacagcgcccaaagaaggagaaaaagctaaagaagcaggatgatgaagcagataaagcattgacctcagatgaggagaggaacaatgcacagctggaattttatgatgagcccaaggtaattaactggggggatgcagctctaggagagaatgaactttgagtaacataatggacctgttgtttcctggtacattttgttaaacactatttctgtgctttcctatcaattattacaggcattgattgtgattatgttcaatacttaagcttcttttggttgctttttgcttattgtattgttgctgtgctttttattgttgtgattctcattagtttgctttatcgtagaaattcaatagtaagagttaaggaagataggcatgtagcttgattacctacatgtctatcgccagggaaatgtctaatctgtctacttagtagcctggaaacgaacggtagacccttagattttaatttagtttaatttttagtttagtttaagttagtttagagtaggtataaagatgccagtgccggggccacgcggagtacgatcgagggtacagcactaggacgcccattaggggaagagctaaattttagtttaagttaagtttaattggctaagtatagttaaaatttataggctagtatagagttagagca

SEQ ID NO: 15 - DNA, 27608 bp, Coronavirus; identical to SEQ ID NO: 14

SEQ ID NO: 16 - DNA, 20500 bp, Coronavirus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatctcccaaaccacgggatgtcattcttgtgtccaaagacatccctgaacaactttgtgacgctttgtttttctatacgtcacataaccctaaggattacgctgatgcttttgcagttaggcagaagtttgaccgtagtctccagactgggaaacagttcaaatttgaaactgtgtgtggtctcttcctcttgaagggagttgacaaaataacacctggcgtcccagcaaaagttttaaaagccacttctaagttggcagatttagaagacatctttggtgtctctcctttagcgcggaagtaccgtgaattgttgaaaacagcgtgtcagtggtctcttactgtagaagcactggatgttcgtgcacaaactctcgatgaaatttttgaccccactgaaatactttggcttcaggtggctgcaaaaattcatgtttcatctatggcaatgcgcaggcttgttggagaagtaactgcaaaagtcatggatgctctgggctcaaacttgagtgctctttttcaaattgttaaacaacaaatagccagaatctttcaaaaggcactggctatttttgagaatgtgaatgaattaccacagcgtattgcagcacttaagatggcttttgccaagtgtgctaggtcaattactgttgtggttgttgaaagaactctagttgttaaagagttcgcaggaacttgtcttgcaagcattaatggtgctgtcgcaaaattctttgaagagttgccaaacggcttcatgggttctaagattttcacaacacttgccttctttaaagaggcagctgtgagagttgtggagaacataccaaatgcaccgagaggtactaagggatttgaagttgttggcaatgccaaaggcacacaggtagttgtgcgcggcatgcgaaatgacttaacattgcttgaccaaaaagctgatattcctgttgaaccagaaggttggtctgcaattttggatggacatctttgctatgtctttaggagtggtgatcgcttttatgctgcacctctttcaggaaattttgctttgagtgatgttcattgctgtgagcgtgtagtctgtctatctgatggtgtaacaccggagataaatgatggactcattctagctgcaatctactcttcttttagtgtctctgagcttgtaacagctcttaaaaagggtgaaccattcaagttcttgggccataaattcgtgtatgcgaaggatgcagcagtgtcttttactttagcgaaggctgccactattgcagatgtcttgaggctgtttcaatcagctcgtgtgatagcagaagatgtttggtcttcatttactgaaaagtcttttgaattctggaagcttgcatatggaaaagtgcgcaaccttgaagaatttgtgaagacctatgtttgtaaggctcaaatgtcgattgtgattctagcagcagtgcttggagaggacatttggcatcttgtctcacaagtcatctataaattaggtgttctttttactaaagtcgttgacttttgtgacaaacactggaaaggtttttgtgtacagttgaaaagagctaagctcattgtcaccgaaaccttctgtgttttaaaaggagttgcacagcattgttttcaactgctgctagatgcaatacactctttgtacaagagttttaagaagtgtgcacttggtagaatccatggagatttgctcttctggaaaggaggtgtgcataaaattgttcaagatggcgatgaaatatggtttgacgccattgatagtgttgatgttgaagatctgggtgttgttcaggaaaaatcgattgattttgaggtttgcgatgacgtgacacttccagaaaaccaacctggtcatatggttcaaatagaggatgatggtaagaactacatgttcttccgttttaaaaaggatgagaacatttattatacaccaatgtctcaacttggtgctattaatgtggtttgcaaagcaggcggtaagactgtcacctttggagaaactacagtacaagagataccaccacctgatgtcgtgcctattaaggttagcatagaatgttgtggtgaaccatggaatacgatcttcaagaaggcttataaagagcctatagaagtagatacagacctcacagtagaacaattgctctctgtgatctatgagaaaatgtgtgacgaccttaaattgtttccagaggcaccagagcctccaccatttgagaatgtcgcacttgttgataagaacggtaaagatttggattgtataaaatcttgccatttgatctatcgtgactatgagagcgatgatgacatcgaggaggaagatgctgaggagtgtgacacagactcaggtgaagctgaggagtgtgacactaattcagaatgtgaagaagaggatgaggatactaaagtgttggctcttatacaagacccggcaagtattaaataccctctgcctcttgatgaagattatagcgtctataatggatgtattgtacacaaggacgctcttgatgttgtgaatttaccatctggtgaagaaacttttgttgtcaataactgttttgagggagctgttaaaccacttccacagaaggtagttgatgttcttggtgactggggagaggctgttgatgcgcaagaacaactgtgtcaacaagagcctctgcaacatacctttgaagaaccagtcgaaaattctactggtagttctaagacaatgactgaacaagtcgttgtagaagatcaagaactacctgttgttgaacaagatcaggatgtagttgtttatacacctacagatcttgaagttgcaaaagaaacagcagaagaggttgatgagtttattctcatttttgctgttcctaaagaagaagttgtgtcccagaaagatggggcacagattaaacaagagcctattcaagttgttaaaccacaacgtgagaagaaggctaaaaagttcaaagttaaaccagccacatgtgagaaacctaaatttttggagtataaaacatgtgtgggtgatttgactgttgtaattgccaaagcattggatgagtttaaagagttctgcattgtaaatgctgcaaatgagcatatgactcatggtagtggcgttgcaaaggcaattgcagacttttgtggactggattttgttgaatattgtgaggactatgttaagaaacatgggccacaacagagacttgttacaccttcgtttgtcaaaggcattcaatgtgtgaataatgttgtaggaccccgccatggagacaacaacttgcatgagaagcttgttgctgcctacaagaatgtgcttgtagatggcgtagtcaattatgttgtgccagttctttcattaggaatttttggtgtagattttaaaatgtcaatagacgcaatgcgtgaagcttttgaaggttgcaccatacgcgttcttttgttttctctgagccaagaacacatcgattatttcgatgtaacttgcaaacagaagacaatttatcttacggaggatggtgttaaataccgctccattgttctaaaacctggtgactcattgggtcaatttggacaggtttatgctaaaaacaagatagtttttacagccgatgatgttgaggacaaagaaattctctacgtccccacgactgataaaagcattcttgaatactatggtttagatgcgcaaaagtatgtaatatatttgcaaacgcttgcgcagaaatggaatgtccaatatagggacaattttcttatactagagtggcgcgatggaaattgttggattagttcagcaatagttctccttcaagctgctaaaattaggtttaaaggttttctaacagaagcgtgggctaaactgttaggtggagatcctacagactttgttgcctggtgttatgcaagttgtactgctaaagtaggtgatttctcagatgctaattggcttttagcgaatttagcagaacattttgacgcagattacacaaatgcgtttcttaagaagcgcgtttcgtgtaactgtggtattaagagctatgagcttagaggccttgaagcttgtattcagccagttcgggcaactaatctgctacattttaagacgcaatattcaaattgcccaacctgtggcgcaaataatacggatgaagtaatagaagcttcgttaccgtacttattgctttttgctactgatggtcctgctacagttgattgtgatgaagatgctgtggggactgtcgtgtttgttggttctactaatagtggccattgttatacacaagctgcagggcaagcttttgataatcttgctaaagatagaaaatttggaaagaagtcgccttacattactgcaatgtatacgcgattcgcttttaagaatgaaacctctttgcctgttgctaaacagagcaagggtaagtctaagtcggtaaaggaagatgtttctaaccttgctactagttctaaggccagttttgataatcttactgacttcgaacagtggtatgatagtaacatctatgaaagtcttaaagtgcaggaatcacctgataactttgataaatatgtgtcattcacaacaaaggaagattctaagttgccattgacacttaaggttagaggtattaaatcagttgttgactttagatcgaaggatggttttatttataagttaacacctgatactgatgaaaattcaaaagcaccagtctactacccagtcttggacgctattagtcttaaggcaatatgggtggaaggtaatgctaactttgttgttggtcatccaaattattatagtaagtctcttcatattcctactttttgggaaaatgctgagaattttgttaaaatgggtgataaaattggtggtgtaactatgggactttggcgtgcagaacaccttaataaacctaatttggagagaattttcaacattgctaagaaagccattgttggatctagtgttgttactacacaatgcggtaaattaataggtaaagcagctacattcattgctgataaagtaggtggtggtgtagttcgcaatattacagatagcattaagggtctttgtggaattacacgagggcattttgaaagaaaaatgtctccacaattcctaaagacgcttatgttctttttattctatttcttgaaggctagtgttaagagtgttgtcgctagctataagaccgtgttatgtaaggtggtacttgctactttacttatagtttggtttgtctacacaagtaacccagtaatgtttacaggaatacgtgtgttagattttctattcgagggttctttgtgtggtccttataaagactatggtaaagattcttttgatgtgttacgatattgtgcagatgattttatttgtcgtgtgtgtttacatgacaaagattcacttcatttgtacaaacacgcttatagtgtagagcaggtctataaagatgcagcttctggttttatttttaattggaattggctttatttggtctttctaatattatttgttaaaccagtggcaggttttgttattatttgctattgtgttaagtatttggtattgaattcaactgtgctgcaaactggtgtttgttttttagattggtttgtacaaacagtttttagtcactttaattttatgggagcagggttttatttctggctcttttacaagatatatatacaggtgcatcatatactgtattgtaaggatgtaacatgtgaagtgtgcaaaagggttgcacgcagcaacaggcaagaggttagcgtggttgttggtggacgcaagcagatagtgcatgtttacactaactctggctataacttttgtaagagacataattggtattgtagaaattgtgatgattatggtcaccaaaatacatttatgtctcctgaagttgctggcgagctctctgaaaagcttaagcgccatgttaaacctacagcatacgcttaccacgttgtggatgaggcatgcttagttgatgattttgtcaatttaaaatataaagctgcaactcctggtaaggatagtgcatcttcagctgttaagtgtttcagtgttacagatttcttgaagaaagctgtttttcttaaggaagcactgaaatgtgaacaaatatctaatgatggttttatagtgtgtaatacacagagtgctcatgcattagaggaagcaaagaatgcagccatctattatgcgcaatatctgtgtaagccaatacttatacttgaccaggcactttatgagcaattagtagtagagcctgtgtctaagagtgttatagataaagtgtgtagcattttgtctagtataatatctgtagatactgcagctttaaattataaggcaggcacacttcgtgatgctctgctttctattactaaagacgaagaggccgtagatatggctatattctgtcataatcatgatgtggattacactggtgatggttttactaatgtgataccgtcatatggtatagacactggcaagttaacacctcgtgatagagggtttttgataaatgcagatgcttctattgctaacttaagagttaaaaatgctccgccggtagtatggaagttttctgagcttattaagttgtctgacagttgtcttaaatatttaatttcggctactgttaagtcaggtgttcgtttctttataacaaagtctggtgctaaacaagttattgcttgtcatacacagaagttgttagtagagaaaaaggcaggtggtattgttagcggcacctttaagtgttttaagagttattttaaatggctcttgatcttttacatactttttacagcatgttgttcgggttattactatatggaggtgagtaaaagttttgttcaccccatgtatgatgtaaactccacactgcatgttgaaggttttaaagttatagataaaggtgttcttagggaaattgtaccagaagatacatgtttctctaataaatttgttaattttgatgctttttggggcagaccatatgataatagtagaaactgtccaattgtcacagctgttatagatggtgatgggacagtagctacaggtgttcctggttttgtgtcctgggttatggatggtgttatgtttatacatatgacacagactgagagaaaaccgtggtacattcctacttggtttaatagagaaattgtcggttacactcaggattcaattattactgagggtagtttttatacatctatagcgttattttccgctaggtgtttatatttaacagccagcaatacacctcaattgtattgctttaatggtgataatgatgcacctggggctttgccatttggtagtattattcctcatagagtttatttccaacccaatggtgttaggcttatagttccacaacaaatactgcacacaccctacgtagtaaagtttgtatcagacagctattgtaggggtagtgtgtgtgagtacactagaccaggttactgtgtgtcattaaacccacaatgggttttgtttaatgacgaatacacaagtaaacccggtgttttctgtggttctactgttagagaacttatgtttagtatggttagtacattctttactggtgttaaccccaatatctatatgcaattagcaactatgtttttaatactagttgttgttgtattaatctttgcaatggttataaagtttcaaggtgtttttaaagcttatgcaaccactgtttttataacaatgttagtttgggtaattaacgcatttattttgtgtgtacatagttacaacagtgttttagctgttatattactagtactctattgctatgcgtcattggttacaagtcgcaatactgttataataatgcattgttggcttgtttttacctttggtttaatagtacccacatggttggcttgttgctacctgggatttattatttatatgtatacaccgttgtttttatggtgttatggtactacaaaaaacactcgtaagctgtatgatggcaatgagtttgttggtaattatgatcttgctgcgaagagcacttttgttattcgcggctctgaatttgttaagcttactaatgagataggtgataaatttgaggcctacctttcagcgtatgctagattaaagtactattcaggcactggcagtgaacaagattatttgcaagcttgtcgtgcatggttagcttatgctttggaccaatatagaaatagtggtgtggaaattgtttatactccgccacgttactctattggtgttagtagattacaatctggttttaagaaactggtttctcctagtagtgctgttgaaaagtgcattgttagtgtctcttatagaggtaataatcttaatggactgtggctaggtgacactatctactgtcctcgtcatgtattgggtaagttttcaggtgaccaatggaatgatgtacttaatcttgctaataatcatgagtttgaagttacaactcaacatggtgttactttgaatgttgtcagtaggcgtttaaaaggtgcagttttaattttacaaactgctgttgctaatgctgaaactccaaagtataagtttattaaagctaattgtggtgatagtttcactatagcttgtgcttatggtggtacagttgtaggactctaccctgttactatgcgttctaatggtactattagagcatcttttcttgcgggagcctgtggttcagttggttttaatatagaaaagggtgtagttaatttcttttatatgcaccatcttgagttacctaatgcattacacactggaactgacctaatgggtgaattctatggtggttatgttgatgaagaggttgcacaaagagtgccaccagataatttagttactaacaatattgtagcatggctctatgcggcaattattagtgttaaggagagtagtttctcgctgcctaaatggttggagagtactactgttagtgttgatgattataataagtgggctggtgacaatggttttacaccattttctactagtaccgctattactaaattaagtgctataactggagttgatgtttgtaagctccttcgcactattatggtaaaaaatagccagtggggtggtgaccccattttagggcaatataattttgaagatgaattgacaccggagtctgtatttaatcagattggtggtgttagattacaatcttcttttgtaagaaaagctacatcttggttttggagtagatgtgtgttagcttgcttcttatttgtgttgtgtgctattgtcttgtttacggcagtgccacttaaattttatgtatatgcagctgttattttgttaatggctgtactttttatttcttttactgttaaacatgttatggcatatatggatacttttctattgccaacattgattacagttattattggagtttgtgctgaagtgcctttcatctacaatactctaattagtcaagttgttattttcttaagtcaatggtatgacccagtagtctttgatactatggtaccatggatgttcttgccactagtgttgtatactgcttttaagtgtgtacaaggttgctatatgaattctttcaatacttctttgttaatgctgtatcagtttgtgaagttaggttttgttatttacacctcttctaatactcttactgcatacacagaaggtaattgggagttattcttcgagttggtgcacactactgtgttggctaatgttagtagtaattctttaattggtttatttgtttttaagtgtgctaaatggatgttgtattattgtaatgcaacatacttaaacaattatgtactaatggcagttatggttaactgcattggctggctctgcacttgttactttgggttgtattggtgggttaataaggtttttggtttaaccttaggtaaatacaattttaaagtttcagtagatcaatataggtatatgtgtttgcacaagataaacccacctaaaactgtgtgggaagtcttttcgacaaatatacttatacaaggaattggtggtgaccgtgtgttgcctattgctacagttcaagctaaattgagtgatgtaaagtgtacaactgttgttttaatgcagcttttgactaagcttaatgttgaagcaaattcaaaaatgcatgtttatcttgttgagttacacaataaaattcttgcttctgatgatgttggagagtgcatggataatttgttgggtatgcttataacactattttgtatagattctactattgatttgagtgagtattgtgatgacatacttaagaggtcaactgtattacaatcggttactcaagaattctcacatataccctcttatgctgaatatgaaagggctaagaatctttatgaaaaggttttagttgattctaaaaatggtggtgttacacagcaagagcttgctgcatatcgtaaagctgccaatattgcaaagtcagtttttgatagagacttggctgtccaaaagaagttagatagcatggcagagcgtgctatgacaacaatgtataaagaggcgcgtgtaacagatagacgagcaaaattagtctcatcactacatgcgttacttttctcaatgcttaagaaaatagattctgaaaagcttaatgtcttgtttgaccaggctagtagtggtgttgtgcccctagcgactgttccaattgtttgtagtaataagcttacacttgtaataccagacccagaaacgtgggtcaagtgtgtggaaggtgtgcatgttacatattcaacagttgtttggaatatagacactgttattgatgccgatggcacagagttacacccaacttctacaggtagtggattgacatactgtataagtggtgctaatatagcatggcctttaaaggttaacttgactaggaatgggcataataaggttgatgttgttttgcaaaataatgagcttatgccacatggtgttaaaacaaaggcttgcgtagcaggtgtagatcaagcacattgtagcgtagagtctaaatgttattatacaaatattagtggcaattcagttgtagctgctattacttcttcaaatccaaatctgaaagtagcttcgtttttgaatgaggcaggcaatcagatttatgtagacttagacccaccatgtaaatttggcatgaaagtgggtgtcaaggttgaggttgtttacttgtattttataaagaatacaaggtcgattgttaggggtatggtacttggtgctatatctaatgttgttgtcttacagtctaaagggcatgaaacagaggaagtggatgctgttggcattctttcactatgttcatttgcagtagatcccgcggacacatattgtaaatatgtggcagcaggtaatcaacctttaggtaactgtgttaaaatgttgacagtgcataatggtagtggttttgctataacttcaaagccaagtcctactcctgaccaggattcttatggaggagcttctgtgtgtctctattgtagagcacacatagcacatccaggaagtgtaggaaatttagatggacgttgtcaatttaaaggttcttttgtgcaaatacctactacggagaaagaccccgttggattctgtctacgtaataaggtttgcactgtttgccagtgttggattggttatggatgtcagtgtgattcacttagacaaccaaaatcttctgttcaatcagttgctggagcatctgattttgataagaattatttaaacgggtacggggtagcagtgaggctcggctgataccccttgctagtggatgtgatcctgatgttgtaaagcgagcctttgatgtttgtaataaggaatcagctggtatgtttcaaaatttgaagcgtaactgcgctagattccaggaactacgcgatactgaagatggaaatcttgagtatcttgattcttactttgtagttaaacaaaccactcctagtaattatgaacatgaaaaatcttgttacgaagacttaaagtcagaagtaacagctgaccatgacttctttgtgttcaataagaacatttacaatattagtaggcaacggcttactaaatatactatgatggacttctgctatgctttgagacatttcgacccaaaggattgtgaagttcttaaagaaatacttgtcacttatggttgtatagaagactatcaccctaagtggtttgaggagaataaggattggtacgacccaatagaaaactcaaaatattatgtcatgttggctaaaatgggacctattgtacgacgtgctttattgaatgctattgagttcggaaaccttatggttgaaaaaggttatgttggtgttattacactcgataaccaagaccttaatggcaaattttatgattttggtgattttcagaagacggcacctggtgctggtgttcctgtttttgatacgtattattcttacatgatgcccatcatagccatgacggatgctttagcacctgagaggtactttgaatatgatgtgcacaagggttataaatcttatgatctcctcaagtatgattatactgaggagaaacaagaattgtttcagaagtactttaagtactgggatcaagagtatcatcctaactgccgtgactgtagtgatgacaggtgtttgatacattgtgcaaacttcaatatcttgttttctacacttataccgcagacttctttcggtaatttgtgtagaaaagtttttgttgatggtgtaccatttatagctacttgtggctatcattctaaggaacttggtgttattatgaatcaagataacaccatgtctttttcaaaaatgggtttaagtcaactcatgcagtttgttggagatcctgctttgttagtgggaacatccaataatttagttgatcttagaacgtcttgttttagtgtttgtgcgttaacatctggtattactcatcaaacggtaaagccaggtcactttaacaaggatttctatgattttgcagagaaggctggtatgtttaaggagggttcgtctataccacttaaacattttttctatcctcaaactggtaatgctgctataaacgattatgattattatcgttataacaggcctaccatgtttgacatatgtcaacttctattttgtttagaagtgacttctaaatactttgagtgttatgaaggcggctgtataccagctagccaagttgtagttaacaacttagataagagtgcaggctatccatttaataagtttggaaaagcccgcctctattatgaaatgagtctagaggaacaggaccaactcttcgagattacgaagaagaatgtcctacccactataactcaaatgaatttaaaatatgccatatccgcgaaaaatagagcgcgtacagtggcaggtgtgtctatcctttctactatgactaataggcagtttcatcagaagattcttaagtctatagtcaacactagaaatgcttctgtagttattggaacaaccaagttttatggcggttgggacaacatgttgagaaacctgattcagggtgttgaagacccaattcttatgggttgggattatcctaagtgtgatagagcaatgcctaatttgttgcgtatagcagcatccttagtacttgctcgcaaacacactaactgttgtagttggtctgaacgcatttataggttgtataatgaatgcgcccaggtcttatctgaaactgtacttgctacaggtggtatttatgttaaacctggtggcactagcagtggtgatgctactactgcttatgcaaacagtgtttttaacataatacaagccacatctgctaatgttgcgcgtcttttgagtgttataacgcgtgatattgtctatgataatattaagagcttgcagtatgaattgtatcagcaggtctacaggcgagttaattttgacccagcctttgttgaaaagttttattcttacttatgtaagaatttttcgttgatgatcttgtctgacgacggtgttgtttgttacaacaacacattagccaaacaaggtcttgtagcagatatttctggttttagagaggttctctactatcagaataatgtttttatggctgattctaaatgttgggttgaaccagatttagaaaaaggcccacatgagttttgttcacaacacacaatgctagtggaggttgatggtgagcctaagtatttgccatacccagacccttcacgcattttgggtgcatgtgtttttgtagatgacgtggataagacagaacctgtggctgttatggagcgttatatagctcttgccatagatgcttatccactagtacatcatgaaaatgaagagtacaagaaggtattctttgttctccttgcatatatcagaaaactctatcaagagctttctcagaatatgcttatggactactcttttgtaatggatatagacaagggtagtaaattttgggaacaggagttctatgagaatatgtatagagctcctacgactttacaatcttgtggcgtttgtgtagtttgtaatagtcaaactatactacgctgcggtaattgtattcgtaaaccgtttttgtgttgtaagtgttgctatgaccacgtcatgcatacggaccacaaaaatgttttatctataaatccttatatttgctcacagctaggttgcggtgaagcagatgttactaaattgtacctcgggggtatgtcgtacttctgtggtaatcataaaccgaaattgtcaataccgttagtatctaatggtactgtttttggaatttacagggctaattgtgctggtagtgaaaatgttgatgattttaatcaactagctactactaattggtccattgtcgaaccttatattttagcaaatcgctgtagtgattcattgagacgttttgctgcagagacagtaaaagccacagaagaattacataagcaacaatttgctagtgcagaagtgcgagaagtattctcagatcgtgaattgattctatcatgggaaccaggaaaaaccaggccgccattgaatagaaattatgttttcacaggttatcactttacaagaactagtaaggtgcagcttggtgattttacatttgaaaaaggtgaaggtaaggatgttgtctattataaagcaacgtctactgctaaattgtctgtaggagacatttttgttttaacctcacacaatgttgtttctctcgtagcgccaacattgtgtccacaacaaaccttttctaggtttgtaaatttaagacctaatgtaatggtacctgaatgttttgtaaataacattccactttaccatttagtaggtaaacagaagcgtactacagtacaaggtcctcctggcagtggtaaatcccactttgctataggccttgcagtatactttagtagcgctcgtgttgtttttactgcatgttctcatgcagctgttgatgctttatgtgaaaaagcttttaagtttcttaaagttgatgattgcactcgtatagtaccccaaaggactactgtcgattgcttctcaaaatttaaagctaatgacacaggcaaaaagtacatttttagtactattaatgccttgccggaagttagttgtgatattcttttggttgacgaggttagtatgttgaccaattacgaattgtcctttattaatggtaagataaattaccaatatgttgtgtatgtaggtgatccggctcaattaccggcaccccgcactttacttaatggttcactttctccaaaggattataatgttgtcacaaaccttatggtttgtgttaaacctgatattttccttgcaaagtgttatcgttgtcctaaggaaattgtagacactgtgtctactcttgtttatgatggaaagtttattgcaaataacccagaatcacgtgagtgtttcaaggttatagttaataatggcaattctgatgtaggacatgaaagtggttcagcctacaacacaacacaattggaatttgtgaaagactttgtttgtcgcaataaacaatggcgggaagcaatatttatttcaccttacaatgctatgaaccagagagcttaccgtatgcttggacttaatgttcaaacagtagattcttctcaaggttcagagtatgattatgtcatcttctgtgttactgcagattcgcagcatgcactgaatattaatagatttaatgtggcgcttacaagagctaagcgtggtatactagttgtcatgcgccagcgtgatgaattgtattctgctcttaagtttacagagctagatagtgaaacaagtctgcaaggtacaggtttgtttaaaatttgcaacaaagaatttagtggtgtccatcctgcttatgcagtcacaactaaggctcttgctgcaacctataaagttaatgatgaacttgctgcacttgttaatgtggaagctggttcagaaataacatataaacatcttatttctctgttaggattcaagatgagtgttaatgttgaaggctgccacaacatgtttataacacgtgatgaggcaatccgcaatgtaagaggttgggtaggttttgatgtagaagcaacacatgcttgtggcactaacattggtactaacctgccttttcaagtaggtttctctactggtgcagactttgtagtcacgcctgagggacttgtagatacttcaataggcaataattttgagcctgtgaattctaaagcacctccaggtgaacaatttaaccacttgagagtgttatttaaaagtgctaaaccttggcatgttataagaccaaggatagtgcagatgttagcagacaatctatgcaacgtttcagattgtgtagtgtttgtcacatggtgtcatggcctagaactaactactttgcgctattttgttaaaataggcaaggaacaagtttgttcttgtggttctagagctacaacttttaattctcatactcaagcttatgcttgttggaagcattgtttgggttttgattttgtttataacccacttctagtggatattcaacagtggggttactcgggtaacctacagtttaatcatgatttgcactgtaatgtgcatggccacgctcatgtagcttctgttgacgctataatgactcgttgtcttgcaattaacaatgcattttgtcaagatgtcaactgggatttgacataccctcacattgcaaatgaggatgaagtcaattctagttgtagatatctacaacgcatgtatcttaatgcgtgtgttgatgctcttaaagttaatgttgtctatgatataggcaaccctaaaggtattaaatgtgttaggcgtggggatgttaattttagattctatgataagaatccaatagtacgcaacgtcaagcagtttgagtatgactataatcagcacaaagataagtttgctgatggtctttgtatgttttggaattgtaatgtggattgttatcctgataattccttggtttgtaggtatgacacacgaaatttgagtgtgtttaacctaccaggctgtaatggtggtagtctgtacgttaacaaacatgcattctacacacctaaatttgaccgcattagcttccgcaatttgaaagctatgccattctttttttatgactcatcgccttgtgaaaccattcaagtggatggagttgcgcaagaccttgtgtctctagctacgaaagactgtatcacaaagtgcaacattggtggcgctgtttgtaagaaacatgcccagatgtatgcagaatttgtgacttcttacaatgcagctgtcacagctggctttactttctgggtaactaataaacttaacccttataacttatggaaaagtttttcagctctccagtctatcgacaatattgcttataatatgtataagggtggtcattatgatgctattgctggagaaatgcccactgtcataactggagacaaagtttttgttattgatcaaggtgtagaaaaggcagtttttgttaatcaaacaactctacctacatctgtggcgtttgagctatatgcaaagagaaatattcgcacactgccaaacaaccgtattttgaaaggtttaggtgtagacgtaaccaatggatttgtaatttgggattatgctaaccaaacaccattgtatcgtaataccgtcaaggtatgtgcatatacagatattgagccaaatggcctagtagttctgtatgatgatagatatggtgattaccagtcttttcttgctgctgataatgctgttctagtttctacacagtgttataagcgatattcatacgtagaaataccatctaatttgctcgttcagaatggtatgccattaaaagatggagcgaacctgtatgtttataagcgtgttaatggtgcgtttgttacactacctaacacaataaacacccagggtcgaagttatgaaacttttgaacctcgtagtgacattgagcgtgattttctcgctatgtcagaggagagttttgtagaaaggtatggtaaagacttaggcctacaacacatactgtatggtgaagttgataagccccaattaggtggtttacacactgttataggtatgtacagactcttacgtgcgaataagttgaacgcaaagtctgtaactaattcggattctgatgtcatgcaaaattactttgtattgtcggacaatggttcttacaagcaagtgtgtactgttgtggatttactgcttgatgatttcttagaacttcttagaaacatacttaaggagtatggtactaataagtcaaaagttgtaacagtgtcaattgattaccatagcataaattttatgacttggtttgaagatggcagtattaaaacatgttatccacagcttcaatcagcatggacgtgtggttataatatgcctgaactttataaagttcagaattgtgttatggaaccttgcaacattcctaattatggtgttggaataacgttgcctagcggtattcttatgaatgtggcaaagtatacacaactttgtcaatacctttcgaaaacaacaatttgtgtaccgcataacatgcgagtaatgcatttcggagcaggaagcgacaaaggagtggcgccaggtagtactgttcttaaacaatggctcccagaagggacactccttgtcgataatgatattgtagactatgtgtctgatgcacatgtttctgtgctttcagattgcaataaatataatacagagcacaagtttgatcttgtgatatctgatatgtatacagataatgattcaaaaagaaagcatgaaggcgtgatagccaataatggcaatgatgacgttttcatatatctctcaagttttcttcgtaacaatttggctctaggtggtagttttgctgtaaaagtgacagagacaagttggcacgaagttttatatgacattgcacaggattgtgcatggtggacaatgttttgtacagcagtgaatgcctcttcttcagaagcattcttgattggtgttaattatttgggtgcaagtgaaaaggttaaggttagtggaaaaacgctgcacgcaaattatatattttggaggaattgtaattatttacaaacctctgcttatagtatatttgacgttgctaagtttgatttgagattgaaagcaacgccagttgttaatttgaaaactgaacaaaagacagacttagtctttaatttaattaagtgtggtaagttactggtaagagatgttggtaacacctcttttactagtgactcttttgtgtgcactatgtagtgctgttttgtatgacagtagttcttacgtttactactaccaaagtgccttcagaccacctagtggttggcatttacaagggg

SEQ ID NO: 17 - DNA, 27635 bp, Coronavirus
acttaagatagatattaatatatatctattacactagccttgcgctagatttttaacttaacaaaacggacttaaatacctacagctggtcctcataggtgttccattgcagtgcactttagtgccctggatggcacctggccacctgtcaggtttttgttattaaaatcttattgttgctggtatcactgcttgttttgccgtgtctcactttatacatctgttgcttgggctacctagtgtccagcgtcctacgggcgtcgtggctggttcgagtgcgaggaacctctggttcatctagcggtaggcgggtgtgtggaagtagcacttcagacgtaccggttctgttgtgtgaaatacggggtcacctccccccacatacctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatctcccaaaccacgggatgtcattcttgtgtccaaagacatccctgaacaactttgtgacgctttgtttttctatacgtcacataaccctaaggattacgctgatgcttttgcagttaggcagaagtttgaccgtagtctccagactgggaaacagttcaaatttgaaactgtgtgtggtctcttcctcttgaagggagttgacaaaataacacctggcgtcccagcaaaagttttaaaagccacttctaagttggcagatttagaagacatctttggtgtctctcctttagcgcggaagtaccgtgaattgttgaaaacagcgtgtcagtggtctcttactgtagaagcactggatgttcgtgcacaaactctcgatgaaatttttgaccccactgaaatactttggcttcaggtggctgcaaaaattcatgtttcatctatggcaatgcgcaggcttgttggagaagtaactgcaaaagtcatggatgctctgggctcaaacttgagtgctctttttcaaattgttaaacaacaaatagccagaatctttcaaaaggcactggctatttttgagaatgtgaatgaattaccacagcgtattgcagcacttaagatggcttttgccaagtgtgctaggtcaattactgttgtggttgttgaaagaactctagttgttaaagagttcgcaggaacttgtcttgcaagcattaatggtgctgtcgcaaaattctttgaagagttgccaaacggcttcatgggttctaagattttcacaacacttgccttctttaaagaggcagctgtgagagttgtggagaacataccaaatgcaccgagaggtactaagggatttgaagttgttggcaatgccaaaggcacacaggtagttgtgcgcggcatgcgaaatgacttaacattgcttgaccaaaaagctgatattcctgttgaaccagaaggttggtctgcaattttggatggacatctttgctatgtctttaggagtggtgatcgcttttatgctgcacctctttcaggaaattttgctttgagtgatgttcattgctgtgagcgtgtagtctgtctatctgatggtgtaacaccggagataaatgatggactcattctagctgcaatctactcttcttttagtgtctctgagcttgtaacagctcttaaaaagggtgaaccattcaagttcttgggccataaattcgtgtatgcgaaggatgcagcagtgtcttttactttagcgaaggctgccactattgcagatgtcttgaggctgtttcaatcagctcgtgtgatagcagaagatgtttggtcttcatttactgaaaagtcttttgaattctggaagcttgcatatggaaaagtgcgcaaccttgaagaatttgtgaagacctatgtttgtaaggctcaaatgtcgattgtgattctagcagcagtgcttggagaggacatttggcatcttgtctcacaagtcatctataaattaggtgttctttttactaaagtcgttgacttttgtgacaaacactggaaaggtttttgtgtacagttgaaaagagctaagctcattgtcaccgaaaccttctgtgttttaaaaggagttgcacagcattgttttcaactgctgctagatgcaatacactctttgtacaagagttttaagaagtgtgcacttggtagaatccatggagatttgctcttctggaaaggaggtgtgcataaaattgttcaagatggcgatgaaatatggtttgacgccattgatagtgttgatgttgaagatctgggtgttgttcaggaaaaatcgattgattttgaggtttgcgatgacgtgacacttccagaaaaccaacctggtcatatggttcaaatagaggatgatggtaagaactacatgttcttccgttttaaaaaggatgagaacatttattatacaccaatgtctcaacttggtgctattaatgtggtttgcaaagcaggcggtaagactgtcacctttggagaaactacagtacaagagataccaccacctgatgtcgtgcctattaaggttagcatagaatgttgtggtgaaccatggaatacgatcttcaagaaggcttataaagagcctatagaagtagatacagacctcacagtagaacaattgctctctgtgatctatgagaaaatgtgtgacgaccttaaattgtttccagaggcaccagagcctccaccatttgagaatgtcgcacttgttgataagaacggtaaagatttggattgtataaaatcttgccatttgatctatcgtgactatgagagcgatgatgacatcgaggaggaagatgctgaggagtgtgacacagactcaggtgaagctgaggagtgtgacactaattcagaatgtgaagaagaggatgaggatactaaagtgttggctcttatacaagacccggcaagtattaaataccctctgcctcttgatgaagattatagcgtctataatggatgtattgtacacaaggacgctcttgatgttgtgaatttaccatctggtgaagaaacttttgttgtcaataactgttttgagggagctgttaaaccacttccacagaaggtagttgatgttcttggtgactggggagaggctgttgatgcgcaagaacaactgtgtcaacaagagcctctgcaacatacctttgaagaaccagtcgaaaattctactggtagttctaagacaatgactgaacaagtcgttgtagaagatcaagaactacctgttgttgaacaagatcaggatgtagttgtttatacacctacagatcttgaagttgcaaaagaaacagcagaagaggttgatgagtttattctcatttttgctgttcctaaagaagaagttgtgtcccagaaagatggggcacagattaaacaagagcctattcaagttgttaaaccacaacgtgagaagaaggctaaaaagttcaaagttaaaccagccacatgtgagaaacctaaatttttggagtataaaacatgtgtgggtgatttgactgttgtaattgccaaagcattggatgagtttaaagagttctgcattgtaaatgctgcaaatgagcatatgactcatggtagtggcgttgcaaaggcaattgcagacttttgtggactggattttgttgaatattgtgaggactatgttaagaaacatgggccacaacagagacttgttacaccttcgtttgtcaaaggcattcaatgtgtgaataatgttgtaggaccccgccatggagacaacaacttgcatgagaagcttgttgctgcctacaagaatgtgcttgtagatggcgtagtcaattatgttgtgccagttctttcattaggaatttttggtgtagattttaaaatgtcaatagacgcaatgcgtgaagcttttgaaggttgcaccatacgcgttcttttgttttctctgagccaagaacacatcgattatttcgatgtaacttgcaaacagaagacaatttatcttacggaggatggtgttaaataccgctccattgttctaaaacctggtgactcattgggtcaatttggacaggtttatgctaaaaacaagatagtttttacagccgatgatgttgaggacaaagaaattctctacgtccccacgactgataaaagcattcttgaatactatggtttagatgcgcaaaagtatgtaatatatttgcaaacgcttgcgcagaaatggaatgtccaatatagggacaattttcttatactagagtggcgcgatggaaattgttggattagttcagcaatagttctccttcaagctgctaaaattaggtttaaaggttttctaacagaagcgtgggctaaactgttaggtggagatcctacagactttgttgcctggtgttatgcaagttgtactgctaaagtaggtgatttctcagatgctaattggcttttagcgaatttagcagaacattttgacgcagattacacaaatgcgtttcttaagaagcgcgtttcgtgtaactgtggtattaagagctatgagcttagaggccttgaagcttgtattcagccagttcgggcaactaatctgctacattttaagacgcaatattcaaattgcccaacctgtggcgcaaataatacggatgaagtaatagaagcttcgttaccgtacttattgctttttgctactgatggtcctgctacagttgattgtgatgaagatgctgtggggactgtcgtgtttgttggttctactaatagtggccattgttatacacaagctgcagggcaagcttttgataatcttgctaaagatagaaaatttggaaagaagtcgccttacattactgcaatgtatacgcgattcgcttttaagaatgaaacctctttgcctgttgctaaacagagcaagggtaagtctaagtcggtaaaggaagatgtttctaaccttgctactagttctaaggccagttttgataatcttactgacttcgaacagtggtatgatagtaacatctatgaaagtcttaaagtgcaggaatcacctgataactttgataaatatgtgtcattcacaacaaaggaagattctaagttgccattgacacttaaggttagaggtattaaatcagttgttgactttagatcgaaggatggttttatttataagttaacacctgatactgatgaaaattcaaaagcaccagtctactacccagtcttggacgctattagtcttaaggcaatatgggtggaaggtaatgctaactttgttgttggtcatccaaattattatagtaagtctcttcatattcctactttttgggaaaatgctgagaattttgttaaaatgggtgataaaattggtggtgtaactatgggactttggcgtgcagaacaccttaataaacctaatttggagagaattttcaacattgctaagaaagccattgttggatctagtgttgttactacacaatgcggtaaattaataggtaaagcagctacattcattgctgataaagtaggtggtggtgtagttcgcaatattacagatagcattaagggtctttgtggaattacacgagggcattttgaaagaaaaatgtctccacaattcctaaagacgcttatgttctttttattctatttcttgaaggctagtgttaagagtgttgtcgctagctataagaccgtgttatgtaaggtggtacttgctactttacttatagtttggtttgtctacacaagtaacccagtaatgtttacaggaatacgtgtgttagattttctattcgagggttctttgtgtggtccttataaagactatggtaaagattcttttgatgtgttacgatattgtgcagatgattttatttgtcgtgtgtgtttacatgacaaagattcacttcatttgtacaaacacgcttatagtgtagagcaggtctataaagatgcagcttctggttttatttttaattggaattggctttatttggtctttctaatattatttgttaaaccagtggcaggttttgttattatttgctattgtgttaagtatttggtattgaattcaactgtgctgcaaactggtgtttgttttttagattggtttgtacaaacagtttttagtcactttaattttatgggagcagggttttatttctggctcttttacaagatatatatacaggtgcatcatatactgtattgtaaggatgtaacatgtgaagtgtgcaaaagggttgcacgcagcaacaggcaagaggttagcgtggttgttggtggacgcaagcagatagtgcatgtttacactaactctggctataacttttgtaagagacataattggtattgtagaaattgtgatgattatggtcaccaaaatacatttatgtctcctgaagttgctggcgagctctctgaaaagcttaagcgccatgttaaacctacagcatacgcttaccacgttgtggatgaggcatgcttagttgatgattttgtcaatttaaaatataaagctgcaactcctggtaaggatagtgcatcttcagctgttaagtgtttcagtgttacagatttcttgaagaaagctgtttttcttaaggaagcactgaaatgtgaacaaatatctaatgatggttttatagtgtgtaatacacagagtgctcatgcattagaggaagcaaagaatgcagccatctattatgcgcaatatctgtgtaagccaatacttatacttgaccaggcactttatgagcaattagtagtagagcctgtgtctaagagtgttatagataaagtgtgtagcattttgtctagtataatatctgtagatactgcagctttaaattataaggcaggcacacttcgtgatgctctgctttctattactaaagacgaagaggccgtagatatggctatattctgtcataatcatgatgtggattacactggtgatggttttactaatgtgataccgtcatatggtatagacactggcaagttaacacctcgtgatagagggtttttgataaatgcagatgcttctattgctaacttaagagttaaaaatgctccgccggtagtatggaagttttctgagcttattaagttgtctgacagttgtcttaaatatttaatttcggctactgttaagtcaggtgttcgtttctttataacaaagtctggtgctaaacaagttattgcttgtcatacacagaagttgttagtagagaaaaaggcaggtggtattgttagcggcacctttaagtgttttaagagttattttaaatggctcttgatcttttacatactttttacagcatgttgttcgggttattactatatggaggtgagtaaaagttttgttcaccccatgtatgatgtaaactccacactgcatgttgaaggttttaaagttatagataaaggtgttcttagggaaattgtaccagaagatacatgtttctctaataaatttgttaattttgatgctttttggggcagaccatatgataatagtagaaactgtccaattgtcacagctgttatagatggtgatgggacagtagctacaggtgttcctggttttgtgtcctgggttatggatggtgttatgtttatacatatgacacagactgagagaaaaccgtggtacattcctacttggtttaatagagaaattgtcggttacactcaggattcaattattactgagggtagtttttatacatctatagcgttattttccgctaggtgtttatatttaacagccagcaatacacctcaattgtattgctttaatggtgataatgatgcacctggggctttgccatttggtagtattattcctcatagagtttatttccaacccaatggtgttaggcttatagttccacaacaaatactgcacacaccctacgtagtaaagtttgtatcagacagctattgtaggggtagtgtgtgtgagtacactagaccaggttactgtgtgtcattaaacccacaatgggttttgtttaatgacgaatacacaagtaaacccggtgttttctgtggttctactgttagagaacttatgtttagtatggttagtacattctttactggtgttaaccccaatatctatatgcaattagcaactatgtttttaatactagttgttgttgtattaatctttgcaatggttataaagtttcaaggtgtttttaaagcttatgcaaccactgtttttataacaatgttagtttgggtaattaacgcatttattttgtgtgtacatagttacaacagtgttttagctgttatattactagtactctattgctatgcgtcattggttacaagtcgcaatactgttataataatgcattgttggcttgtttttacctttggtttaatagtacccacatggttggcttgttgctacctgggatttattatttatatgtatacaccgttgtttttatggtgttatggtactacaaaaaacactcgtaagctgtatgatggcaatgagtttgttggtaattatgatcttgctgcgaagagcacttttgttattcgcggctctgaatttgttaagcttactaatgagataggtgataaatttgaggcctacctttcagcgtatgctagattaaagtactattcaggcactggcagtgaacaagattatttgcaagcttgtcgtgcatggttagcttatgctttggaccaatatagaaatagtggtgtggaaattgtttatactccgccacgttactctattggtgttagtagattacaatctggttttaagaaactggtttctcctagtagtgctgttgaaaagtgcattgttagtgtctcttatagaggtaataatcttaatggactgtggctaggtgacactatctactgtcctcgtcatgtattgggtaagttttcaggtgaccaatggaatgatgtacttaatcttgctaataatcatgagtttgaagttacaactcaacatggtgttactttgaatgttgtcagtaggcgtttaaaaggtgcagttttaattttacaaactgctgttgctaatgctgaaactccaaagtataagtttattaaagctaattgtggtgatagtttcactatagcttgtgcttatggtggtacagttgtaggactctaccctgttactatgcgttctaatggtactattagagcatcttttcttgcgggagcctgtggttcagttggttttaatatagaaaagggtgtagttaatttcttttatatgcaccatcttgagttacctaatgcattacacactggaactgacctaatgggtgaattctatggtggttatgttgatgaagaggttgcacaaagagtgccaccagataatttagttactaacaatattgtagcatggctctatgcggcaattattagtgttaaggagagtagtttctcgctgcctaaatggttggagagtactactgttagtgttgatgattataataagtgggctggtgacaatggttttacaccattttctactagtaccgctattactaaattaagtgctataactggagttgatgtttgtaagctccttcgcactattatggtaaaaaatagccagtggggtggtgaccccattttagggcaatataattttgaagatgaattgacaccggagtctgtatttaatcagattggtggtgttagattacaatcttcttttgtaagaaaagctacatcttggttttggagtagatgtgtgttagcttgcttcttatttgtgttgtgtgctattgtcttgtttacggcagtgccacttaaattttatgtatatgcagctgttattttgttaatggctgtactttttatttcttttactgttaaacatgttatggcatatatggatacttttctattgccaacattgattacagttattattggagtttgtgctgaagtgcctttcatctacaatactctaattagtcaagttgttattttcttaagtcaatggtatgacccagtagtctttgatactatggtaccatggatgttcttgccactagtgttgtatactgcttttaagtgtgtacaaggttgctatatgaattctttcaatacttctttgttaatgctgtatcagtttgtgaagttaggttttgttatttacacctcttctaatactcttactgcatacacagaaggtaattgggagttattcttcgagttggtgcacactactgtgttggctaatgttagtagtaattctttaattggtttatttgtttttaagtgtgctaaatggatgttgtattattgtaatgcaacatacttaaacaattatgtactaatggcagttatggttaactgcattggctggctctgcacttgttactttgggttgtattggtgggttaataaggtttttggtttaaccttaggtaaatacaattttaaagtttcagtagatcaatataggtatatgtgtttgcacaagataaacccacctaaaactgtgtgggaagtcttttcgacaaatatacttatacaaggaattggtggtgaccgtgtgttgcctattgctacagttcaagctaaattgagtgatgtaaagtgtacaactgttgttttaatgcagcttttgactaagcttaatgttgaagcaaattcaaaaatgcatgtttatcttgttgagttacacaataaaattcttgcttctgatgatgttggagagtgcatggataatttgttgggtatgcttataacactattttgtatagattctactattgatttgagtgagtattgtgatgacatacttaagaggtcaactgtattacaatcggttactcaagaattctcacatataccctcttatgctgaatatgaaagggctaagaatctttatgaaaaggttttagttgattctaaaaatggtggtgttacacagcaagagcttgctgcatatcgtaaagctgccaatattgcaaagtcagtttttgatagagacttggctgtccaaaagaagttagatagcatggcagagcgtgctatgacaacaatgtataaagaggcgcgtgtaacagatagacgagcaaaattagtctcatcactacatgcgttacttttctcaatgcttaagaaaatagattctgaaaagcttaatgtcttgtttgaccaggctagtagtggtgttgtgcccctagcgactgttccaattgtttgtagtaataagcttacacttgtaataccagacccagaaacgtgggtcaagtgtgtggaaggtgtgcatgttacatattcaacagttgtttggaatatagacactgttattgatgccgatggcacagagttacacccaacttctacaggtagtggattgacatactgtataagtggtgctaatatagcatggcctttaaaggttaacttgactaggaatgggcataataaggttgatgttgttttgcaaaataatgagcttatgccacatggtgttaaaacaaaggcttgcgtagcaggtgtagatcaagcacattgtagcgtagagtctaaatgttattatacaaatattagtggcaattcagttgtagctgctattacttcttcaaatccaaatctgaaagtagcttcgtttttgaatgaggcaggcaatcagatttatgtagacttagacccaccatgtaaatttggcatgaaagtgggtgtcaaggttgaggttgtttacttgtattttataaagaatacaaggtcgattgttaggggtatggtacttggtgctatatctaatgttgttgtcttacagtctaaagggcatgaaacagaggaagtggatgctgttggcattctttcactatgttcatttgcagtagatcccgcggacacatattgtaaatatgtggcagcaggtaatcaacctttaggtaactgtgttaaaatgttgacagtgcataatggtagtggttttgctataacttcaaagccaagtcctactcctgaccaggattcttatggaggagcttctgtgtgtctctattgtagagcacacatagcacatccaggaagtgtaggaaatttagatggacgttgtcaatttaaaggttcttttgtgcaaatacctactacggagaaagaccccgttggattctgtctacgtaataaggtttgcactgtttgccagtgttggattggttatggatgtcagtgtgattcacttagacaaccaaaatcttctgttcaatcagttgctggagcatctgattttgataagaattatttaaacgggtacggggtagcagtgaggctcggctgataccccttgctagtggatgtgatcctgatgttgtaaagcgagcctttgatgtttgtaataaggaatcagctggtatgtttcaaaatttgaagcgtaactgcgctagattccaggaactacgcgatactgaagatggaaatcttgagtatcttgattcttactttgtagttaaacaaaccactcctagtaattatgaacatgaaaaatcttgttacgaagacttaaagtcagaagtaacagctgaccatgacttctttgtgttcaataagaacatttacaatattagtaggcaacggcttactaaatatactatgatggacttctgctatgctttgagacatttcgacccaaaggattgtgaagttcttaaagaaatacttgtcacttatggttgtatagaagactatcaccctaagtggtttgaggagaataaggattggtacgacccaatagaaaactcaaaatattatgtcatgttggctaaaatgggacctattgtacgacgtgctttattgaatgctattgagttcggaaaccttatggttgaaaaaggttatgttggtgttattacactcgataaccaagaccttaatggcaaattttatgattttggtgattttcagaagacggcacctggtgctggtgttcctgtttttgatacgtattattcttacatgatgcccatcatagccatgacggatgctttagcacctgagaggtactttgaatatgatgtgcacaagggttataaatcttatgatctcctcaagtatgattatactgaggagaaacaagaattgtttcagaagtactttaagtactgggatcaagagtatcatcctaactgccgtgactgtagtgatgacaggtgtttgatacattgtgcaaacttcaatatcttgttttctacacttataccgcagacttctttcggtaatttgtgtagaaaagtttttgttgatggtgtaccatttatagctacttgtggctatcattctaaggaacttggtgttattatgaatcaagataacaccatgtctttttcaaaaatgggtttaagtcaactcatgcagtttgttggagatcctgctttgttagtgggaacatccaataatttagttgatcttagaacgtcttgttttagtgtttgtgcgttaacatctggtattactcatcaaacggtaaagccaggtcactttaacaaggatttctatgattttgcagagaaggctggtatgtttaaggagggttcgtctataccacttaaacattttttctatcctcaaactggtaatgctgctataaacgattatgattattatcgttataacaggcctaccatgtttgacatatgtcaacttctattttgtttagaagtgacttctaaatactttgagtgttatgaaggcggctgtataccagctagccaagttgtagttaacaacttagataagagtgcaggctatccatttaataagtttggaaaagcccgcctctattatgaaatgagtctagaggaacaggaccaactcttcgagattacgaagaagaatgtcctacccactataactcaaatgaatttaaaatatgccatatccgcgaaaaatagagcgcgtacagtggcaggtgtgtctatcctttctactatgactaataggcagtttcatcagaagattcttaagtctatagtcaacactagaaatgcttctgtagttattggaacaaccaagttttatggcggttgggacaacatgttgagaaacctgattcagggtgttgaagacccaattcttatgggttgggattatcctaagtgtgatagagcaatgcctaatttgttgcgtatagcagcatccttagtacttgctcgcaaacacactaactgttgtagttggtctgaacgcatttataggttgtataatgaatgcgcccaggtcttatctgaaactgtacttgctacaggtggtatttatgttaaacctggtggcactagcagtggtgatgctactactgcttatgcaaacagtgtttttaacataatacaagccacatctgctaatgttgcgcgtcttttgagtgttataacgcgtgatattgtctatgataatattaagagcttgcagtatgaattgtatcagcaggtctacaggcgagttaattttgacccagcctttgttgaaaagttttattcttacttatgtaagaatttttcgttgatgatcttgtctgacgacggtgttgtttgttacaacaacacattagccaaacaaggtcttgtagcagatatttctggttttagagaggttctctactatcagaataatgtttttatggctgattctaaatgttgggttgaaccagatttagaaaaaggcccacatgagttttgttcacaacacacaatgctagtggaggttgatggtgagcctaagtatttgccatacccagacccttcacgcattttgggtgcatgtgtttttgtagatgacgtggataagacagaacctgtggctgttatggagcgttatatagctcttgccatagatgcttatccactagtacatcatgaaaatgaagagtacaagaaggtattctttgttctccttgcatatatcagaaaactctatcaagagctttctcagaatatgcttatggactactcttttgtaatggatatagacaagggtagtaaattttgggaacaggagttctatgagaatatgtatagagctcctacgactttacaatcttgtggcgtttgtgtagtttgtaatagtcaaactatactacgctgcggtaattgtattcgtaaaccgtttttgtgttgtaagtgttgctatgaccacgtcatgcatacggaccacaaaaatgttttatctataaatccttatatttgctcacagctaggttgcggtgaagcagatgttactaaattgtacctcgggggtatgtcgtacttctgtggtaatcataaaccgaaattgtcaataccgttagtatctaatggtactgtttttggaatttacagggctaattgtgctggtagtgaaaatgttgatgattttaatcaactagctactactaattggtccattgtcgaaccttatattttagcaaatcgctgtagtgattcattgagacgttttgctgcagagacagtaaaagccacagaagaattacataagcaacaatttgctagtgcagaagtgcgagaagtattctcagatcgtgaattgattctatcatgggaaccaggaaaaaccaggccgccattgaatagaaattatgttttcacaggttatcactttacaagaactagtaaggtgcagcttggtgattttacatttgaaaaaggtgaaggtaaggatgttgtctattataaagcaacgtctactgctaaattgtctgtaggagacatttttgttttaacctcacacaatgttgtttctctcgtagcgccaacattgtgtccacaacaaaccttttctaggtttgtaaatttaagacctaatgtaatggtacctgaatgttttgtaaataacattccactttaccatttagtaggtaaacagaagcgtactacagtacaaggtcctcctggcagtggtaaatcccactttgctataggccttgcagtatactttagtagcgctcgtgttgtttttactgcatgttctcatgcagctgttgatgctttatgtgaaaaagcttttaagtttcttaaagttgatgattgcactcgtatagtaccccaaaggactactgtcgattgcttctcaaaatttaaagctaatgacacaggcaaaaagtacatttttagtactattaatgccttgccggaagttagttgtgatattcttttggttgacgaggttagtatgttgaccaattacgaattgtcctttattaatggtaagataaattaccaatatgttgtgtatgtaggtgatccggctcaattaccggcaccccgcactttacttaatggttcactttctccaaaggattataatgttgtcacaaaccttatggtttgtgttaaacctgatattttccttgcaaagtgttatcgttgtcctaaggaaattgtagacactgtgtctactcttgtttatgatggaaagtttattgcaaataacccagaatcacgtgagtgtttcaaggttatagttaataatggcaattctgatgtaggacatgaaagtggttcagcctacaacacaacacaattggaatttgtgaaagactttgtttgtcgcaataaacaatggcgggaagcaatatttatttcaccttacaatgctatgaaccagagagcttaccgtatgcttggacttaatgttcaaacagtagattcttctcaaggttcagagtatgattatgtcatcttctgtgttactgcagattcgcagcatgcactgaatattaatagatttaatgtggcgcttacaagagctaagcgtggtatactagttgtcatgcgccagcgtgatgaattgtattctgctcttaagtttacagagctagatagtgaaacaagtctgcaaggtacaggtttgtttaaaatttgcaacaaagaatttagtggtgtccatcctgcttatgcagtcacaactaaggctcttgctgcaacctataaagttaatgatgaacttgctgcacttgttaatgtggaagctggttcagaaataacatataaacatcttatttctctgttaggattcaagatgagtgttaatgttgaaggctgccacaacatgtttataacacgtgatgaggcaatccgcaatgtaagaggttgggtaggttttgatgtagaagcaacacatgcttgtggcactaacattggtactaacctgccttttcaagtaggtttctctactggtgcagactttgtagtcacgcctgagggacttgtagatacttcaataggcaataattttgagcctgtgaattctaaagcacctccaggtgaacaatttaaccacttgagagtgttatttaaaagtgctaaaccttggcatgttataagaccaaggatagtgcagatgttagcagacaatctatgcaacgtttcagattgtgtagtgtttgtcacatggtgtcatggcctagaactaactactttgcgctattttgttaaaataggcaaggaacaagtttgttcttgtggttctagagctacaacttttaattctcatactcaagcttatgcttgttggaagcattgtttgggttttgattttgtttataacccacttctagtggatattcaacagtggggttactcgggtaacctacagtttaatcatgatttgcactgtaatgtgcatggccacgctcatgtagcttctgttgacgctataatgactcgttgtcttgcaattaacaatgcattttgtcaagatgtcaactgggatttgacataccctcacattgcaaatgaggatgaagtcaattctagttgtagatatctacaacgcatgtatcttaatgcgtgtgttgatgctcttaaagttaatgttgtctatgatataggcaaccctaaaggtattaaatgtgttaggcgtggggatgttaattttagattctatgataagaatccaatagtacgcaacgtcaagcagtttgagtatgactataatcagcacaaagataagtttgctgatggtctttgtatgttttggaattgtaatgtggattgttatcctgataattccttggtttgtaggtatgacacacgaaatttgagtgtgtttaacctaccaggctgtaatggtggtagtctgtacgttaacaaacatgcattctacacacctaaatttgaccgcattagcttccgcaatttgaaagctatgccattctttttttatgactcatcgccttgtgaaaccattcaagtggatggagttgcgcaagaccttgtgtctctagctacgaaagactgtatcacaaagtgcaacattggtggcgctgtttgtaagaaacatgcccagatgtatgcagaatttgtgacttcttacaatgcagctgtcacagctggctttactttctgggtaactaataaacttaacccttataacttatggaaaagtttttcagctctccagtctatcgacaatattgcttataatatgtataagggtggtcattatgatgctattgctggagaaatgcccactgtcataactggagacaaagtttttgttattgatcaaggtgtagaaaaggcagtttttgttaatcaaacaactctacctacatctgtggcgtttgagctatatgcaaagagaaatattcgcacactgccaaacaaccgtattttgaaaggtttaggtgtagacgtaaccaatggatttgtaatttgggattatgctaaccaaacaccattgtatcgtaataccgtcaaggtatgtgcatatacagatattgagccaaatggcctagtagttctgtatgatgatagatatggtgattaccagtcttttcttgctgctgataatgctgttctagtttctacacagtgttataagcgatattcatacgtagaaataccatctaatttgctcgttcagaatggtatgccattaaaagatggagcgaacctgtatgtttataagcgtgttaatggtgcgtttgttacactacctaacacaataaacacccagggtcgaagttatgaaacttttgaacctcgtagtgacattgagcgtgattttctcgctatgtcagaggagagttttgtagaaaggtatggtaaagacttaggcctacaacacatactgtatggtgaagttgataagccccaattaggtggtttacacactgttataggtatgtacagactcttacgtgcgaataagttgaacgcaaagtctgtaactaattcggattctgatgtcatgcaaaattactttgtattgtcggacaatggttcttacaagcaagtgtgtactgttgtggatttactgcttgatgatttcttagaacttcttagaaacatacttaaggagtatggtactaataagtcaaaagttgtaacagtgtcaattgattaccatagcataaattttatgacttggtttgaagatggcagtattaaaacatgttatccacagcttcaatcagcatggacgtgtggttataatatgcctgaactttataaagttcagaattgtgttatggaaccttgcaacattcctaattatggtgttggaataacgttgcctagcggtattcttatgaatgtggcaaagtatacacaactttgtcaataccttttgaaaacaacaatttgtgtaccgcataacatgcgagtaatgcatttcggagcaggaagcgacaaaggagtggcgccaggtagtactgttcttaaacaatggctcccagaagggacactccttgtcgataatgatattgtagactatgtgtctgatgcacatgtttctgtgctttcagattgcaataaatataatacagagcacaagtttgatcttgtgatatctgatatgtatacagataatgattcaaaaagaaagcatgaaggcgtgatagccaataatggcaatgatgacgttttcatatatctctcaagttttcttcgtaacaatttggctctaggtggtagttttgctgtaaaagtgacagagacaagttggcacgaagttttatatgacattgcacaggattgtgcatggtggacaatgttttgtacagcagtgaatgcctcttcttcagaagcattcttgattggtgttaattatttgggtgcaagtgaaaaggttaaggttagtggaaaaacgctgcacgcaaattatatattttggaggaattgtaattatttacaaacctctgcttatagtatatttgacgttgctaagtttgatttgagattgaaagcaacgccagttgttaatttgaaaactgaacaaaagacagacttagtctttaatttaattaagtgtggtaagttactggtaagagatgttggtaacacctcttttactagtgactcttttgtgtgcactatgtagtgctgttttgtatgacagtagttcttacgtttactactaccaaagtgccttcagaccacctagtggttggcatttacaagggggtgcttatgcggtagttaacatttctagcgaatttaataatgcaggctcttcatcagggtgtactgttggtattattcatggtggtcgtgttgttaatgcttcttctatagctatgacggcaccgtcatcaggtatggcttggtctagcagtcagttttgtactgcacactgtaatttttcagatactacagtgtttgttacacattgttataaacatggtgggtgtcctttaactggcatgcttcaacagaatcttatacgtgtttctgctatgaaaaatggccagcttttctataatttaacagttagtgtagctaagtaccctacttttagatcatttcagtgtgttaataatttaacatccgtatatttaaatggtgatcttgtttacacctctaatgagaccatagatgttacatctgcaggtgtttattttaaagctggtggacctataacttataaagttatgagagaagttaaagccctggcttattttgttaatggtactgcacaagatgttattttgtgtgatggatcacctagaggcttgttagcatgccagtataatactggcaatttttcagatggcttttatccttttactaatagtagtttagttaagcagaagtttattgtctatcgtgaaaatagtgttaatactacttgtacgttacacaatttcatttttcataatgagactggcgccaaccctaatcctagtggtgttcagaatattcaaacttaccaaacaaaaacagctcagagtggttattataattttaatttttcctttctgagtagttttgtttataaggagtctaattttatgtatggatcttatcacccaagttgtaaatttagactagaaactattaataatggcttgtggtttaattcactttcagtttcaattgcttacggtcctcttcaaggtggttgcaagcaatctgtctttaaaggtagagcaacttgttgttatgcttattcatatggaggtccttcgctgtgtaaaggtgtttattcaggtgagttagatcataattttgaatgtggactgttagtttatgttactaagagcggtggctctcgtatacaaacagccactgaaccgccagttataactcaaaacaattataataatattactttaaatacttgtgttgattataatatatatggcagaactggccaaggttttattactaatgtgaccgactcagctgttagttataattatctagcagacgcaggtttggctattttagatacatctggttccatagacatctttgttgtacaaggtgaatatggtcttaattattataaggttaacccttgcgaagatgtcaaccagcagtttgtagtttctggtggtaaattagtaggtattcttacttcacgtaatgagactggttctcagcttcttgagaaccagttttacatcaaaatcactaatggaacacgtcgttttagacgttctattactgaaaatgttgcaaattgcccttatgttagttatggtaagttttgtataaaacctgatggctcaattgccacaatagtaccaaaacaattggaacagtttgtggcacctttatttaatgttactgaaaatgtgctcatacctaacagtttcaacttaactgttacagatgagtacatacaaacgcgtatggataaggtccaaattaattgcctgcagtatgtttgtggcagttctctggattgtagaaagttgtttcaacaatatgggcctgtttgcgacaacatattgtctgtagtaaatagtgttggtcaaaaagaagatatggaacttttgaatttctattcttctactaaaccggctggttttaatacaccagttcttagtaatgttagcactggtgagtttaatatttctcttctgttaacaaatcctagtagtcgtagaaagcgttctcttattgaagaccttctatttacaagcgttgaatctgttggactaccaacaaatgacgcatataaaaattgcactgcaggacctttaggcttttttaaggaccttgcgtgtgctcgtgaatataatggtttgcttgtgttgcctcctatcataacagcagaaatgcaagctttgtatactagttctctagtagcttctatggcttttggtggtattactgcagctggtgctataccttttgccacacaactgcaggctagaattaatcacttgggtattacccagtcacttttgttgaagaatcaagaaaaaattgctgcttcctttaataaggccattggtcatatgcaggaaggttttagaagtacatctctagcattacaacaaattcaagatgttgttagtaaacagagtgctattcttactgagactatggcatcacttaataaaaattttggtgctatttcttctgtgattcaagaaatctaccagcaatttgacgccatacaagcaaatgctcaagtggatcgtcttataactggtagattgtcatcactttctgttttagcatctgctaagcaggcggagtatattagagtgtcacaacagcgtgagttagctactcagaaaattaatgagtgtgttaagtcacagtctattaggtactccttttgtggtaatggacgacatgttctaaccataccgcaaaatgcacctaatggtatagtgtttatacacttttcttatactccagatagttttgttaatgttactgcaatagtgggtttttgtgtaaagccagctaatgctagtcagtatgcaatagtgcccgctaatggtaggggtatttttatacaagttaatggtagttactacatcactgcacgagatatgtatatgccaagagctattactgcaggagatgtagttacgcttacttcttgtcaagcaaattatgtaagtgtaaataagaccgtcattactacattcgtagacaatgatgattttgattttaatgacgaattgtcaaaatggtggaatgatactaagcatgagctaccagactttgacaaattcaattacacagtacctatacttgacattgatagtgaaattgatcgtattcaaggcgttatacagggtcttaatgactctctaatagaccttgaaaaactttcaatactcaaaacttatattaagtggccttggtatgtgtggttagccatagcttttgccactattatcttcatcttaatactaggatgggttttcttcatgactggttgttgtggttgttgttgtggatgctttggcattatgcctctaatgagtaagtgtggtaagaaatcttcttattacacgacttttgataacgatgtggtaactgaacaatacagacctaaaaagtctgtttgatgatccaaagtcccacgtccttcctaatagtattaattcttctttggtgtaaacttgtactaagttgttttagagagtttattatagcgctccaacaactaatacaagttttactccaaattatcaatagtaacttacagtctagactgaccctttggcacagtctagactaatgttaaacttagaagtaattattgaaactggtgagcaagtgattcaaaaaatcagtttcaatttacagcatatttcaagtgtattaaacacagaagtatttgatccctttgactattgttattacagaggaggtaatttttgggaaatagagtcagctgaagattgttcaggtgatgatgaatttattgaataagtcgctagaggagaatggaagttttctaacagcgctttacataattgtaggatttttagcactttatcttctaggtagagcacttcaagcatttgtacaggctgctgatgcttgttgtttattttggtatacatgggtagtaattccaggagctaagggtacagcctttgtatacaagtatacatatggtagaaaacttaacaatccggaattagaagcagttattgttaacgagtttcctaagaacggttggaataataaaaatccagcaaattttcaagatgcccaacgagacaaattgtactcttgactttgaacagtcagttcagctttttaaagagtataatttatttataactgcattcttgttgttcttaaccataatacttcagtatggctatgcaacaagaagtaaggttatttatacactgaaaatgatagtgttatggtgcttttggccccttaacattgcagtaggtgtaatttcatgtacatacccaccaaacacaggaggtcttgtcgcagcgataatacttacagtgtttgcgtgtctgtcttttgtaggttattggatccagagtattagactctttaagcggtgtaggtcatggtggtcatttaatccagaatctaatgccgtaggttcaatactcctaactaatggtcaacaatgtaattttgctatagagagtgtgccaatggtgctttctccaattataaagaatggtgttctttattgtgagggtcagtggcttgctaagtgtgaaccagaccacttgcctaaagatatatttgtttgtacaccggatagacgtaatatctaccgtatggtgcagaaatatactggtgaccaaagcggaaataagaaaaggtttgctacgtttgtctatgcaaagcagtcagtagatactggcgagctagaaagtgtagcaacaggaggaagtagtctttacacataaatgtgtgtgtgtagagagtatttaaaattattctttaatagcgcctctgttttaagagcgcataagagtatttattttgaggatactaatataaatcctctttgttttatactctcctttcaagagctattaacggtgttacctttcaagtagataatggaaaagtctactacgaaggaacaccagttttccaaaaaggttgttgtaggatgtggtccaattataagaaagaataattgaaccacctactacacttatttttataagaggtgttttacttaacaaaaacttaacaaatacggacgatgaaatggctgactagttttggaagagcagttatttcttgttataaatccctactattaactcaacttagagtgttagataggttaattttagatcacggactactacgcgttttaacgtgtagtaggcgcgtgcttttagttcaattagatttagtttataggttggcgtatacgcccacccaatcgctggcatgaataatagtaaagataatccttttcgcggagcaatagcaagaaaagctcgaatttatctgagagaaggattagattgtgtttactttcttaacaaagcaggacaagcagagccttgtcccgcgtgtacctctctagtattccaagggaaaacttgtgaggaacacatacataataataatcttttgtcatggcaagcggtaaagcagctggaaaaacagacgccccagcgccagtcattaaactaggaggaccaaaaccacctaaagtcggttcttctggaaatgcatcttggtttcaagcaataaaagccaagaagttaaatacacctccgcccaagtttgaaggtagcggtgttcctgataacgaaaacattaagccaagccagcaacatggatactggagacgccaagccaggtttaagccaggcaaaggtggaagaaaaccagtcccagatgcttggtacttttactatactggaacaggacctgccgctgacctgaactggggtgatactcaagatggtatagtgtgggttgctgctaagggtgctgatactaaatctagatccaatcagggtacaagagatcctgataagtttgaccaatacccactacgattctcggatggcggacctgatggtaatttccgttgggacttcattcccctgaaccgtggtaggagtggaagatcaacagcagcttcatcagcagcagctagtagagcaccatcacgtgaaggttcgcgtggtcgtagaagtgattctggagatgaccttattgctcgtgcagcaaagataatccaggatcagcagaaaaagggctctcgcattaccaaggcaaaggcagatgaaatggctcatcgccggtattgcaagcgcactatcccacctaattatagggttgatcaagtgtttggtccccgtactaaaggtaaggaggggaattttggtgatgacaagatgaatgaggaaggtattaaggatgggcgtgttacagcaatgctcaacctagtccctagcagccatgcttgtctttttggaagtagagtgacacccaaacttcaactagatgggcttcacttgagatttgaatttactactgtggtcccatgtgatgacccgcagtttgataattatgtgaaaatttgtgatcagtgtgtcgatggtgtaggaacgcgtccaaaagatgacgaaccaaaaccaaagtcacgctcaagttcaagacctgctacaagaggaaattctccagcgccaagacaacagcgcccaaagaaggagaaaaagctaaagaagcaggatgatgaagcagataaagcattgacctcagatgaggagaggaacaatgcacagctggaattttatgatgagcccaaggtaattaactggggggatgcagctctaggggagaatgaactttgagtaacataatggacctgttgtttcctggtacattttgttaaacactatttctgtgctttcctatcaattattacaggcattgattgtgattatgttcaatacttaagcttcttttggttgctttttgcttattgtattgttgctgtgctttttattgttgtgattctcattagtttgctttatcgtagaaattcaatagtaagagttaaggaagataggcatgtagcttgattacctacatgtctatcgccagggaaatgtctaatctgtctacttagtagcctggaaacgaacggtagacccttagattttaatttagtttaatttttagtttagtttaagttagtttagagtaggtataaagatgccagtgccggggccacgcggagtacgatcgagggtacagcactaggacgcccattaggggaagagctaaattttagtttaagttaagtttaattggctaagtatagttaaaatttataggctagtatagagttagagcaaaaaaaaaaaaaaaaaaaaaaaaaaaa

SEQ ID NO: 18 - DNA, 27733 bp, Coronavirus
acttaagatagatattaatatatatctattgcactagccttgcgctagatttccaacttaacaaaacggacttaaatacctacagctggtccctataggtgttccattgcagtgcactttagtgccctggatggcacctggccacctgtcaggttttagttattaaatttttattgttgctagtatcactgcttgttttgttgtgtctcactttattacatccgttgcttgggctacctagtgccagcgtcctgcggacgccgtggtcggttcgagtgcgaggaacctctggttcatctagcggtacgcgggtgtgtggaagtagcgcttcaggcgtacgtgttcctgttgcgtgaaacacggggtcacctccccccacattcctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggctccaagcctaaaacagggagtatctccccaaaaccagaggagtgtcgttcttgttgccaaagacattcccgatcaactccgtgacgctttgtttttctatacgtcacacaacccaaaagattacgctgatgctttcgcttttaagcagaagtttgatcgtaatctgggcgctgggaagcagtttaaatttgaaactgtgtgtggtccattctttcttaaaggagtggataaagtaacaccaggggtcccagctaaagttttgaaagccacttcaaaattggctgatttagaagacatctttggtgtctcaccttttgcacggaaataccgtgaacttcttaaaacagcatgccagtggtctcttactgtagatgcgctggatgctcgtgcccaaactcttgaagaaatttttgaaccaactgaagtactttggctccaggtggcttcaaaacttcaggtttcagctatggcaatgcgcagacttgttggtgaagtaactgcaaaagtcatggatgctttgggctcaaatttgagttctctttttcaaattgtgaaacagcaaatagccagaatttttcagaaagctctggctatttttgaagatgtaaaagacttaccacaacgcatagctgcactgcagatggcttttgcaaagtgcgctaaaacaattactgttgttgttgtggaaaaagctattgttgttcgcgaattttctggaacttgtcttgcaagtattaatggtgccattgctaagttccttgcggaactacccaatggttttatgggatctaaagtttttagcacgctggctttctttaaagaggcagctgttaaaattgtagagaatgtcccaggagcaccgcaaggtactaaaggttttgaagttgttggcaatgccaaaggcacacaagttgtaattcgtggcatgcgaaatgacttaacactgcttgaccaaaaagctgagattcctgttgaaccagaaggctggtctgcaattctggatggacatctttgttatgtctttaagagtggtgacagattttatgctgcgcctttgtcaggaaactttgcacttcatgatgtgcattgctgtgaacgtgttgtctgtcttgttgatggtgttacaccggagattaatgacggactcattcttgcagcaatctactcgtcatttagtgtgtctgaaattgtggctgcacttaagaaaggtgaaccattcaagtttcttggccataagtttgtgtatgcaaaggaagctgctgtctccttcacattggcaaaagcagctactatttctgatgtcttgaagctgtttcaatctgctagagtaaagacagaggatgtgtggtctgcacttactgaaaagtcttttgaattctggaaactcgcatatggaaaagtgcgaaatcttgaggaatttgtgaagactcatttctgtaaagcccaaatgtcaattgtcgttctagcagtagtgcttggtgaaggcatttggcatcttgtttctcaagtcatctataggttgggtggtttgtttgctaaagttactgatttttgtgcaaagtactggaaaggtttctgcgaacaattgaaaaaggctaagcttcttgtcacagaacacctatgtgtcctgaaaggtgttgcacagcattgttttcaacttttgctggatgcaatacattctatgtacaagagctttcaaaaatgtgcacttggtagaatccatggagatttactcttctggaaaggaggtgtacacaaagtagttcagggaggcgacgaaatttggttcgacgccattgacagtattgatgttgaagacctgggtgtcatccaagaaaaacctgtagattttgaggtttgtgatggtataatacttccagaaaatcaacctggtcatatggtccagtttgaagatgatggaaagaactatatgttcttccgcttcaaacgtgaagacaatgtttattatacaccaatgtcacaacttggtgcaattaatgtagtttgcaaagcaggtggcaagactgtcacgtttggtgaaactactgtgaaagaaataccaccacctgatgtggtgcctattaaggttagcatcgagtgttgtggtgatccatggaatccaatcttcaagaaggcttataaagagcccattgaagtagaaacagacctcacagtagagcaattgctcactgtgatctacgagaaaatgtgtgacgacctcaaattgtttcctgaggctccagaacctccactatttgagaatgttgcacttgttgataagagcggtaaagacttggattgcataaaatcatgccatctcatttaccgcgactatgagagtgatgatgacatcgaagaggaagacgctgaggagtgcgacacagcttcagaagatgctgaggagtgtgacacaagttcagagtgtgaagaagaggatgagggtacaaaggtcttggctcttatacaagatccagcaagtcaaaagtaccccctccctcttgatgatgattacagtgtctataatggatgtatagtccataaggatgctcttgatgttgtgaatctaccatccggtgaagaaacttttgttatcaacaactgctttgagggagctgtaaaacaacttccaaagtcggttgtagatgtacttggtgactggggtgaagctgttgatgcacaggagaagtccttgaatgacgtagctgattccagtagtgtttcgttgccgattgaagagccggtaacaattcataaacaggaatttgttcctgttgtagaagaagagctagatgttatagtttgcactccagctgaattaagtgttgtaaaggaagctccaggagaggttgacgagttcatccttattccaagtgtttctaatggtgaagaagtagtttctgctgtgggtgcgccacagcaggaagaatctagagaagaagttgttcctgatattttgcaacaggaagagcctaaaattgaagagcctcctcaagttgtaaaaatacaacgtgagaggaaagctaagaagttcaaagttaagccaaccacacaaaaagttcctaattgtttggagtataaaacttgtgtgggcgatttgactgttgtgatagccaaagcattggatgagtttaaagagttctgccttgtaaacgccgcaaatgattatatgtctcacggaggtggcgttgcaaaagcaattgcagacttttgtggtccagactttgtggagtattgtgaagactatgttaagaaacatggtccccagaaaagacttgtcacaccttcttatgttaaaggcattcaatgtgtgaacaatgttgtaggcccacgccatgcagacagtgatgtgtttggaaagctagttactgcgtacaagaatgtcattgttgatggcgtagtcaattacgttgtaccagttctttcatctggaatttttggagttgactttaagttgtcaatagatgctatgcgtgtagcttttgcggattgcaacatacgcgttcttctattttctctgaaccaagagcatgtcgattatttcgacgctacttgcaaacagaagacaatctttcttacagaagatggtgttaaataccgctctgttactgttaaacctggagactctttgggtcaatttggacaggtttttacacgacataagacagtctttactgcagatgatgttgaggataaagaaattctcttcattccaactgcagacaaggctgtccttgattattatggtttggatgcgaaaaagtatgtgatatatttacatacgctttcacaaaaatggaaaatcctacttaaggacaattttattcaacttgagtggcgtgatggaaattgttggattaattcagcaatagtaatccttcaggctgctaagattaagtttaaaggttttcttgaagaagcatgggctaagctattgggtggagatcctacagatttcgtagcatggtgctatgcgagttgcaatgctaatgttggtgatttctcagacaccaactggcttttggctaatttggctgagcattttgaagtggattacacgaatgcacttcttaagaagcgtgtttcttgtaattgtggtgttaagaattatgagtttaggggccttgaagcttgtattcaaccagtaaaggcacctaacctgttacattttaagacacagtactcaaactgtctcacttgtggttctaatagtgtagatgaagtgatagaagcctcgctgccttatttgctgcttcttgctacagatggtcctgctgcagttgattgtgatgaaaatgctgtaggaaatgttgttttcattgggtccactaataggggtcattgttatacacaagctgttggaacagcttttgataatttggctcaagataggaaatttggaaagaaatcgccttacattactgcgatgtatacgcgcttctctcttaaaagtaaaaaccttatgcctattgctaagaagagcaaaggtaaaaatcaagtagtaaaagaagatgtttctaatcttgctattagttcaaaagccagttttgataatcttactgactttgagcagtggtatgatagtaacatctatgagagtcttaaagtgcaggaaacacctgacaatcttgatgaatatgtgtcatttacaacaaaggaggattccaagttgccattgacacttaaagttcgtggtgttaaatcagttgttgattttaagtcgaaagatggctttacttataaattaacacctgatattgatgaaaattcaaaggcacccgtttattaccctgtcttagactctgttagtcttaaggcaatttgggttgacggaagtgcaaactttgttgttggacatccaaattataatagtagagctttgcgaattcccactttctgggagtatgcagagagttttgttaaaatgggtgaaaaagttaatggtgttactatgggcttatggcgcacagaacaccttaataaacccaatttggaaaatcttttcaacatcgttaagaaaatggttgttggaactaatattgttactactcagtgtggtagactaattggtaagactgcatcatttatagctgataaagtaggagatggtgtagttcgtaatgttactgatagaattaaagggtgttttgggtttactagggagcactttgaaagaagagtgtctctacagttctttaaaaccctctttttcttctttttctgtcttttgaaggctagtgctaagagtttaatgtctagctacaagagtgtgctacgtaaagtggtatttactgctttacttatactatggtttgtctacacaagcaatccagttatatttactggaatacgtgtgttagatttcctacttgaaggttcattttgtagtccttatgcagattacggtaaagagtcttttgatattttacgctattgtggaagtgacttcacctgtcgagtatgtttacatggtaaggattcgcttcatttgtataaacatgcctatagcgtagaacagttatacaaagatgcagttaatggcatcagttttacatggaattggctttatatgctgttcttaatattgtttgttaagccagtggcaggttttgttattatttgctactgtataagatatttggttttaagcacaactgtattgcaaactggtgtaggatttttagactggtttattcaaacagtgtttgctaacttcaattttatgggtgcaggattttacttctggctcttttataagatatatatacaggtccatcatataatgtactgtaaggatataacatgtgaagtgtgtaagaaagttgcacgcagtaatagacatgaagttagtgttgttgttaatgggcgtaaacagcttgttcacgtatacactaattctggttacactttctgtaagaaacataattggtattgtaagaattgtgacaagtatggtcaccagaatacatttatgtctcctgaagttgctggtgagctttcagaaaagcttaaacgccatgttaaacctacagcacatgcataccacgtagtggatgatgcatgcttagttgatgactttgttaatctgaagtacaatgctgccaccccaggtaaagaaggtgtgcattctgctgttaaatgttttagtgtatctgatttcttaaagaaagcagtctttcttaaggatgcacaaaaatgtgaacaaacagccactgatagttttatagtttgtaatacacacagtgcgcatgctttggaggaagctaaaaatgctgccatctattatgcgcaatgtctttgtaaaccaattcttatacttgaccaggctctttatgaccaattgattgtagaacctgtgtccaagagtgttgtagacaaagtgtgtaatattttgtctaatataatatctgtagattctgcagctttgaattataaggcgggcacacttcgtgataccctcctttctgtcactaaggatgaagaagctgttgatatggctattttctgccataataatgacgttgaatatactactgatggttttaccaatgtggcgccatcatatggtatagacactggtaagttaacacctcgagatagaggctttttgataaatgcagatgctgccattgctaacttgaaagtgaaaaattcaccgccagtagtgtggaagtattctgatcttgttaaactgtctgacagttgtcttaagtgtttaatatcagcaactgtaaaatcaggaggtagatttttcataactaggtctggtgctaaacaagttattgcttgttatactcagaaattgttagtggaaaagaaggctggtggtgttattagtagcactgttaataggtttaagagtttatgtaaatggctcttagtgttttatttactttttacagcgtgttgtttgtgttattatcaatgggaaatgagtaaagaatttgctcaccccatgtatgatgttaactctacagtgcatgtagaagggtttaaggttattgacaagggtgtactcagggatattatgccagaagacacttgtttctctaataagtatgtaaattctgactcattttggggtaaaccttatgtaaatagtagagactgtcctattgtaaccgctattatagatggcgctggaacagtagctgctggtgttcctggttttgtacagtgggtcatggatggtgtaatgtttatccatatgacacagactgagcgaagaccgtggtacattcctacttggtttaatagagaaattgttggttatactcatgattctattgttacagaaggtgagttttatacttccatagcattgtttgcttctagatgtttgtatttaacatctagtaacacaccacagctttactgctttaatggtgatagcgatgctcctggagcattaccgtttgcaagtatactccctcatagagtatattttcaacctaatggagttaggcttattgtgcctcagcaaattatgcatacaccatacatagttagacttgtttcagatagctattgtagaggtagtgtttgtgagtatactaaaccgggttattgtgtatcactgaactcccaatgggttttgtttaatgacgaatacacaagtaaaccaggtgtgttttgtggttctactgttagagaacttttgtttagtatggttagcacattttttacgggtgttaatcctaatatctatatgcaattggcgactatgttcttaatacttgttgctgttgtgttagttcttgcaatggttataaagtttcagggtgttttcaaagcttatgcaaccactgtatttactataatgcttgtttggcttattaacgcatttgtattatgtgtacatagttataatagtgtcttagctattatactacttgtgctctattgttatgtatcacttgtgacgagtcgtaatactgccatagtaatgcactgttggcttgttttcacatttggtttaatagtacctaattggatagtttgcgtctatttaggttttattctatatatgtacacaccgctgtttttgtggtgttatggtacaactaaaaatagtcgcaagctttatgaaggcaatgagtttgttggtaattatgatcttgctgcgaagagtacttttgtaattcgtgggcctgaatttgttaaacttacgaatgagctaggcgataaatttgaatcctatctctcagcgtatgctaggcttaaatactactcaggcactggtagtgagcaagattacttgcaagcatgccgtgcatggttggcttatgcactagaccaatttagaagcagtggtgtagaagtagtatacactccgccacggtattctattggtgttagtaggttacaggctggttttaagaaactagtagctcctagtagtgctgttgagaagtgcgttgttagtgtgtcctataggggtaataatcttaatggattgtggctgggtgattctatttactgtccacgtcatgtgttaggtaagtttagtggtgatcaatgggatgatgtacttaaccttgctaataatcatgagtttgaagttgtaactggaaatggtgttactttgaatgttgtcagtaggcgtttgagaggtgcagttttaattttacaaactgctgttgccaatgctgaaactccaaagtataagtttatgaaagcaaattgtggtgatagttttaccattgcttgctcttatggtggtaccgttataggactctatcccgttactatgcgttctaatggaactattagagcatcttttctggcaggagcttgtggctctgtaggttttaatatagaaaagggtgtagtaaatttcttttacatgcaccatttggagttacctaatgcattacacactggaactgacttaacgggtgagttctacggtggttacatagatgaagaggttgctcagaaagttcaacccgataaattggttactaataatattttagcatggctttatgcagcaattattagtgttaaggagagtagtttttcactgcctaaatggcttgaaagtactactgttagtgttgatgattataataagtgggcagcggataatggttttacatcatttgtgagctgcactgctattactaaattaagtgctataacgggagttgatgtttgtaaactccttcgcactattatggtaaaaagtacacaatggggtagtgaccctattctaggacaatataattttgaggatgagatgacaccagaatctgtgtttaatcaggtgggtggtgttagactacaatcttcatttgtaaagaaagctgcgtcttggttttggagtagatgtgtgctagcttgcttcctatttgttttgtgtgctattgtgctgtttacagccataccatataaatattatttacatggtgctgttgttttacttgcaactgtgctttttatttcatttactgtgaaacatgttatggcgtatatggatacttttcttttgccgacattggttacagttattataggagtttgtgttggagtacctttcatttacaatactctaattagtcaaattgttattttctttagccaatggtatgatccagtagtctttgatactgtagtaccgtggatgttcttgcccttagtcttatatacagcttttaaatgtatacaaggttgttatagcgtaaattcctttaacacttctctgttattgttgtatcagtttatgaagttgggttttgttatatacacttcttctaatactgttgcagcatattcagagggtaattgggaattgttttttgatttagttcatactactgtgttggctaatgttagtagtaattctttaattggtttgtttgtcttcaaattggctaagtggatgctgtattattgtaatgcatcataccttaataattatgttctaatggctgtcagtgttaatggcataggttggatgttcacttgttactttggattctattggtggattaataaggttttcggtttaaccttaggcaaatataattttaaagtttcagtagatcaatataggtatatgtgtcttcataagattaaaccgcctaaaactgtgtgggaagtcttttcgacaaatatacttatacaagggataggtggtgagcgtgtgcttcctatagccactgttcaatctaaattaagtgatgtaaagtgtacaactgttgttttaatgcagcttttgactaagcttaatgttgaagcaaattcaaaaatgcatgcttatcttgttgagttacacaataaaattcttgcctcagatgatgttaatgagtgcatggataacttgttgggtatgcttgtaacactattttgtgtagatagtactattgatttaagtgaatattgtgatgacatacttaagagatcaactgttttacaatcagttacgcaggagttttcacatattccttcttatgcagagtatgaaagagctaaagatctctatgaaaaggtcttagctgagtctaaaaatggtggtgttacacagcaagagcttgctgcatatcgtaaagctgccaatattgcaaagtcaatttttgatagagatttggctgttcagaagaagttggatagcatggctgaacgtgctatgacaacaatgtataaggaagcgcgtgttactgatagaagggcgaaacttgtttcatcattacatgcgctattattttctatgcttaagaagatagattctgaaaagcttaatgtactatttgaccaagcaagcagtggtgttgtgccactagctactgttccaatagtttgtagtaataagcttactcttgtagtgccagacccagaaacatgggtcaagtgcgtagagggcatgcatgttacatattcaacagttgtttggaatattgataatgtcactgatgcagatggcactgaattgcaaccaatttctataggtaatggtttaacctattgtataagtggtgataatatagcatggccccttaaggtcaatttgactaggaatgcgcataataaagttgatgcagtattgcagaacaacgagcttatgccgcatggtgttaaaacaaaagcttgcgttgcaggtgtggatcaagcacattgcagcgtagagtctaagtgctattatactaatattagtggtaattcagttgtggctgctattacttcttcaaatcctaatttgaaagttgcctcatttttgaatgaagcaggcaatcaaatttatgttgacttagatccaccatgtaaatttggtatgaaggtgggtgataaagtagaagttgtttacttgtattttataaaaaatacaaggtcaattattagaggtatggtgcttggtgctatatccaatgttgttgtcttacagtctaaagggcatgagacagaagaagtggatgcagttggtatcctctcgctttgttcctttgtagtggatcctgctgacacatatattaaatatgtggcggcaggtaaccaacctttaggtaactgtgttaaaatgttgactgttcataatggtagtggttttgctataacatcaaagccaagtccaacccctgatcaggattcttatggaggagcgtctgtttgtctctattgtagagcacatatagctcatcctggtagtgctggaaacttagatggacgctgtcaatttaagggaagttttgtgcaaatacctactacggagaaagaccctgtcggcttctgtctgcgtaataaggtttgcactgtgtgtcagtgttggattgggcatggctgtcaatgtgatgcacttagacaacctaaaccatctgttcaatcagctgctggtgcaacaaattttgataagaattatttaaacgggtacggggtaacagtgaggctcggctgataccccttgttaatggttgtgaacctgatgttgtaaagcgagcctttgatgtatgtaataaggaatcagccggtatgtttcgaaatttgaagcgtaattgtgcaagattccaagaagtgcgtgatactgaagatggaagtcttgagtattgtgactcttattttgtggttaaacaaaccactcctagtaattatgaacatgagaagtcttgctatgaagacttaaagtcagaagtaacggcttctcatgatttctttgtgttcaataagaacatttataatattagtaggcagaggcttactaaatatactatgatggacttttgctatgctttgaggcattttgaccccaaagattgcgaagttcttaaagaaatacttgtcacttatggttgtatagaagactatcaccctaagtggtttgaagaaaacaaggattggtacgacccaatagaaaacccaaaatattatgccatgttggctaaaatgggccctattgttcgtcgtgcactattaaatgctgttggaaacctaatggttgaaaagggttatgttggtgtagttacacttgacaaccaggacctcaatggcaaattctacgattttggtgattttcagaagacggcacctggtgctggtgttcctgtttttgatacatattactcctatatgatgcccatcatagccatgacggatgctttagcacctgaacggtattttgaatatgatgtgcataaaggttacaaatcttatgatctcctcaagtatgattatacagaggagaaacaagaattgtttcaaaagtactttaagtactgggatcaagagtatcaccctaattgtcgaaattgttacgatgataggtgtctgatacattgtgctaatttcaacatacttttctccactttgatacctcaaacttcttttggtaatctatgtagaaaagtatttgttgatggtgtccctttcatagctacttgtggctatcattctaaggaacttggtgttattatgaatcaagataacaccatgtcattttcaaaaatgggtttgagccagcttatgaaatttgtaggagaccctgcccttttagtaggaacttctaacaatttagttgatcttagaacttcttgttttagtgtctgtgctttaacctctggtataccacaccagacagttaagccaggccacttcaataaggatttttatgattttgctgaaaaagcaggcatgtttaaggaaggatcatcaatcccacttaaacatttcttctatccacagacaggtaatgccgctataaacgattatgattattatcgttataacaggcctactatgtttgatatacgccagcttctattttgtttagaagtgacgtctaaatattttgaatgctatgaaggtggttgtataccagctagtcaagtggttgttactaaccttgataagagtgcaggcttcccctttaataagtttggaaaagcccgtctctattatgaaatgagtctagaggagcaggaccaactctttgaaagtacaaagaaaaatgtcttgcctactataactcagatgaatcttaaatatgccatatccgcgaaaaatagagcgcgtaccgtggcaggtgtgtcaattctttctactatgactaatagacagtttcaccagaaggttcttaagtctatagtcaatactagaaatgcacctgtagttattggaacaactaaattttatggcggttgggacaatatgttaagaaacctaattcaaggtgtagaggacccaatgcttatgggttgggattatcctaagtgtgatagagcaatgccaaatttgttgcgtatagcagcgtctttggtgcttgcccgtaaacatactaattgttgcacatggtctgagcgcatttatagattgtacaatgaatgcgcccaagtattgtctgaaactgtattagctacaggtggtatttacgtaaagccaggtggtactagcagtggtgatgccactactgcttatgccaacagtgtttttaacataatacaagccacgtctgctaatgttgcgcgtttgcttagtgttataacgcgtgatatagtatacgatgacattaaaagcctgcagtatgaattataccaacaggtttataggcgagttaactttgaccctgcctttgttgaaaagttttattcttacatgtgtaagaatttttcattaatgatcctgtctgatgatggtgttgtgtgttataacaacacacttgccaaacaaggtcttgtagcagatatttctggttttagagaaattctctactaccaaaataatgtctatatggcagattctaagtgctgggttgaaccagatttagaaaaaggcccacatgagttttgttcacagcacacaatgcttgtagaggttgatggcgagccaaggtacttgccatatccagacccctcgcgcattttgggtgcatgtgtttttgtagatgaagtggataagacagagcctgtggctgttatggagcgttatattgctcttgccatagacgcttacccgttagttcatcatgagaatgaggagtataggaaagttttctttgtactcctatcttatattagaaagctctatcaggagctctcccaaagtatgcttattgactactcctttgttatggacatagacaagggtagcaaattttgggagcaggagttctatgaaaatatgtatagggctcctacaactttacaatcgtgtggtgtttgtgtagttggtaatagtcagactatactacgctgtggtaatagtattagaaaaccattcttgtgtgcaaatgttgcttatgaccatgtcatgcacactgaccacaaaaacgttttgtctataaacccatatatctgctctcaacctggttgtggtgaagcagatgttactaaactttacctcggaggtatgtcttacttctgtggtaatcataaacctaaattatcaataccgttagtatctaatggtaccgtttttggaatttatagggccaattgtgtaggtagtgaaaatgttgatgattttaatcaactagccaccactaattggtctactgttgaaccttatatattagcgaatcgctgtagcgactcattaagacgctttgctgctgagacagtcaaagcaacagaagagttgcataaacagcaatttgctagtgcagaagtcagagaggttatttctgaccgtgaattaattctatcatgggaacctggtaagactaggcctccattgaacagaaattatgttttcacaggctaccactttactagaactagtaaggtgcaactaggtgattttacttttgaaaaaggtgaaggtagggatgttgtttattatagggcgacgtctactgctaaattgtctcctggagacatttttgtcttaacatcgcacaatgttgtttctcttgtagcaccaactttgtgtcctcaacaaaccttttctaggtttgttaatttaagacctaatgtaatggtaccagaatgttttgtaaataacattccactttaccatttagtaggtaaacaaaagcgtactacagtacaaggccctcctggcagtggtaagtcccactttgctattggccttgctgcatactttagtaacgctcgtgtagtgtttacagcatgctctcatgctgctgtagatgcactttgtgaaaaggcatttaaatttcttaaagttgatgattgcactcgtatagttccacaaaggactactgtcgactgcttctcaaaatttaaagctaatgacacaggcaaaaagtacatttttagtactattaatgccttgccagaagttagttgtgacattctgttggtagatgaagttagtatgttgaccaactacgaattgtcatttattaatggtaagataaattaccagtatgttgtgaatgtaggtgaccctgctcaattaccggcacctcgcactttgcttaatggttcactttcgcccaaggattataatgtcatcacaaatcttatggtttgtgttaaaccagacatcttccttgcgaagtgttaccgttgtcctaaagaaattgtagacactgtgtcgactcttgtttatgatggaaagtttgttgcaaataacccagaatcacgtgagtgtttcaaggttatagttaataatggtaattctgatgtagggcataagagtggttccagcctacaaacacaacaccaattggagtttgtgaaagactttgtttgtcgcaataaacaatggcgagaagcaacatttatttcaccttacaatgctatgaatcagagagcttatcgcatgcttggacttaatgtccagacggtagactcatctcaaggttcagagtatgattatgttatattctgtgttacagctgattctcagcatgcactgaatattaatagatttaatgtagcgcttacaagggctaagcgtggtatacttgttgtcatgcgtcagcgtgatgaattatattctgctcttaaatttacagagttagatgctgaggcaagtctgcaaggtacaggtttgtttaaaatttgcaacaaggaatttagtggagtacatcctgcttatgcagtaaccaccaaagcacttgctgctacctataaggttaatgatgagctagcggcacttgttaatgtagaggctggttcagagataacttataaacatcttatttccctgttagggtttaagatgagtgttaatgttgatggttgtcacaacatgtttataacacgtgatgaggcaatccgcaatgttagaggttgggttggttttgatgtagaagccacacatgcttgtggcactaatattggcactaaccttccatttcaagtaggattctctactggtgctgactttgtagtcacacctgagggtcttgttgatacagcaatgggcaataattttgagcctgtgaactctaaagcacccccaggtgaacaatttaatcacttgagagctttgtttaagagtgctaagccttggcatattataagaccaaggatagttcagatgttagcagacaatctatgcaatgtttcagattgtgtggtgtttgtcacatggtgtcatggccctactaaactaactactttgcgttattttgttaaaataggcaaggactctgtctgttcttgtggttatagagctacaacttttaattctcatactcaggattatgcttgttggaagcactgtttgggttttgattttgtttataatccacttttagtggatattcagcagtggggttactcaggtaatcttcaatttaatcatgatttgcattgtaatgtgcacggacatgctcatgtagcttcagctgatgctgtaatgacccgttgccttgcaattaataatgcattttgtaaagatgtcaactgggaactaacctaccctcatattgcaaatgaggatgaagtaaattccagttgcagatatctacaacgcatgtatcttaatgcgtgtgttgatgctcttaaagttaatgttgtctatgatataggcaaccctaaaggtataaaatgcgttagacgtggggatgtcacatttaggttttatgacaaaaacccaatcgtacccaacgtcaaacagtttgagtatgactatagtcagcataaaaataagtttgctgatggtctgtgtatgttttggaattgtaatgtggattgttatcctgacaattctcttgtctgtaggtatgacacacgtaatttgagtgtgtttaatttacctggttgtaatggtggtagtctgtatgttaataaacatgcattccatacgcctaagtttgagcgtgttagcttccgtaatttgaaagctatgccattctttttctatgactcatcgccttgcgaaaccattcaagttgatggagtagcgcaggaccttgtgtcattagcaactaaagattgtatcacaaaatgcaacattggtggtgctgtttgtaagaagcacgctcaaatgtatgcagaatttgtggcatcttataatgcagctgttacagctggtttcacattctgggtttctaatcaatttaacccgtataatttgtggaaaaatttttcagctctccagtctattgacaatatcgcttataatatgtataagggtgggcattacgatgctattgcaggcgaaatacccacagtcattactggagataaagtctttgttattgatcaaggtattgaaaaggcagtttttgttaatcaaacaacgctgcctacatcagttgcatttgagttgtatgcgaagcgaaatattcgcacactgccaaataatagaatattgagtggtctaggtgtggacgtgacctatggttttgtaatatgggattacgccaaccaaacaccgctgtatcgtaatactgttaaagtatgtgcatacacagacattgagcctaatggcctaatagttctgtatgatgatagatatggtgattaccagtctttcttagctgctgacaatgctgtcttagtgtctacacagtgttataagcggtttccatacgtagaaataccatctaatttgcttgttcagaatggtatgccattaaaagatggagcgaatctgtatgtttataagcgtgttaatggagcgtttgttacgctacctaacacattaaacacacagggtcgtaattatgaagcttttgaacctcgtagtgatgttgagagagatttcctcaacatgtctgaagaggactttattgaaaagtatggtaaggacctaggtctacaacacatactttatggtgaagttgaaaagccacaattgggtggtttacacactgttataggtatgtacaggcttttgcgcgctaataaattagacgcaaaatccgtaactaattcagattctgatgtcatgcaaaactattttgttttggcagacaatggttcttataagcaggtttgcacagttgtggaccttttgcttgacgatttcttagaacttcttaggaacatactaaaagagtatggttctaataagtctaaagttgtaacagtgtccatagactaccatagcataaattttatgacttggtttgaagatggtagtattaaaacatgttacccacaacttcaatcagcgtggacatgtggttataatatgcctgaactctacaaagttcagaattgtgttatggaaccttgtaatattccaaactatggtgttggaattacattgcctagtggtattatgatgaatgtggcgaagtatactcaactttgccagtatctttctaaaactacaatgtgtgtgccgcataatatgcgcgtaatgcactttggagctggtagtgataaaggagttgcacctggtagcactgttcttaaacaatggttacctgagggaacactccttgttgataatgatattgtcgattatgtgtctgatgcacatgtttctgtgctttcagactgcaatagatataagacagagcacaagtttgatcttgtggtatctgatatgtatacagataatgattcaaagagaaaacatgaaggcatagtagccaataatggtaatgacgatgtcttcatttacctatctaatttcttaaggaacaacttagctcttggtggtagttttgccattaaattgacagagacaagttggcatgagagtctttatgatattgcacaggattgtgcatggtggacgatgttttgtacagctgtgaatgcttcatcttcagaagcattcttgattggtgttaattatttgggtgacagcggaaaagtgaaagttagtggaaaaacactgcacgcaaattatatattttggaggaattgtaattatttacaaacctccgcttatagtacatttgacgttgctaagtttgggttaaaactaaaagcaacgccagttgttaatttgaaaactgaacaaaaaaccgacttagtaactaacttactaagtaacggtaaattattggttagagatgttggtgaagtcaacttttttagtgactcttttgtctgcactatgtagtgcagttttgtatgataatggtaattatgtttattactaccaaagtgcatttagacccccaggtggatggcatttgcaagggggtgcttatgcagtagttaattctactaataagtctaataatgcaggcactgcctccgagtgttctgtgggtgttctttttaattatactaacgggaatagtgacgttggttataatcaaagtgcttcctccatagccatgacagcaccgcttcctggtatggcttggtctaaatcacaattttgtactgctcactgtaacttctcggattttacagtgtttattacacattgttttgcaaattcttgtcctttaacaggtaggatagatcagaaccatattcgtatttctgctatgagaaatggttttttattttataatttaacagttagtgtaactaaataccctaactttaaatcgcttcaatgtgttaacaatcacacttccgtttatctaaatggtgatcttgtttttacatctaatcaaaccactgatgtcataggtgctggtgtgtattttaaagcaggtgggcctataatctataaaattatgaaagaatttaaggttttggcttattttgtaaatggcactgtacaagatgttgttttgtgtgatgactcacctagaggattgttggcatgccagtataatactggcaatttttcagatggtttttatccttttactaattctagtttagttaaggaaaagttcattgtttatcgtgaaagtagtgttaatactactttgacgctaactaatttcacttttactaaccaaagtaatgcaccgcccaatagtggtagtgttcaaacttttgttttatatcaaacacaaacagctcagagtggttattataattttaatttatcatttctgaattctttcgtgtataaagcaagtgattttatgtatgggtcgtatcaccccgcctgtcattttagaccagaaaccattaacagtggtttgtggtttaactcgttgtcagtttctcttacctatggacccctacagggagggtgtaagcaatctgtttttagtggtaggacaacgtgttgctatgcctactcttatgatggcccaagagcctgtaaaggtgtctattcaggtgagttaaggaaagattttgaatgtggattgttggtttatgttactaagagtgatggctctcgtatacaaactaggtcagaacccttagtattaactcaacacaattataataatattactttagataagtgcgttgagtataatatatatggcagagaaggccatcttagaattactaatgtgactgattctgctggtaattttaattatctagcagatggtggattagctattttagatgcatctggtgccatagacatttttgttgtacatggcacctatggtcttaattattacaaggttaacccttgtgatgatgttaacaaacagtttgtagtgtcgggtagcaatatagttggtattcttacttctaaaaatgaaacaggttctgaacaggttgagaatcagttttatgttaaattaactaatagctcacgacgtactagacgttccagtagtcgaaatgttacaagctgtccatatgttagttatggcagattttgcattgaaccagatggttcattaaagataatagtgcctgaagaattggagcactttgtggcacctttactaaatgtcactgaacatgtactcatacctacaggttttaatttgactgttacagatgagtacatacaaacacgtatggataaggtccaaatcaactgcctgcaatatatttgtggcaattctttggagtgtagaaaattatttcaacaatatggtccagtttgtgataacatattgtctgttgtaaatagtgttagtcaaaaagaagatatggaacttttaaatttctattcttccaccaaaccaagtggttataattcaccggttttcaataacttgactactggtgaatttaacatttctctcgtactaacgcaacctagtagtcctagtggacgctcgtttgttgaagaccttttatttacaagtgtagaaacagttggtttaccgaccgacgctgagtataagaagtgcacagcaggacctttaggtgctcttaaggatcttgtttgcgctagagaatataatggcttactaatgctgcccccaattattacagcggatatgcagacaatgtatacagcttctttagtagcatctatggcttttggtggtattacagcggctggtgctataccttttgctactcagatacaagctaggattaatcatttaggtattactcagtctcttttgttgaaaaatcaagaaaaaattgcagcctcctttaataaggcaattgtccatatgcaggaaggctttagaagtacttctctagctttacaacaaattcaagatgttgttaacaagcagagtgctattcctgccgaagctttggtagcacttaataaaaattttggtgccatttcttcagtaatgcaagatatttaccagcaacttgatgctattcaagctgacgctcaggttgatcgtctgattactggtagactttcatcactctcagtgttggcagcagctaagcagtctgagtatcttaaagtctcacaacaacgcgaattagccactcagaaaattaatgagtgtgttaaatcgcaatctactaggtattctttttgtggtaatggaagacatgtcttaaccataccacaaaatgcacctaatggtatagtgtttatacactttacttacactcccgagagttttgttaatgtaacagcaatagtaggtttttgcgtaaacccgactaatgctagtcagtatgcaatagtgcccgctaatggaagaggtatttttataagtgttaatggtacatactatatcacagctcgtgatatgtatatgccaagaaacattacttcaggagacatagtaactttaacatcttgtcaagcaaactatgtcagtgttaataaaacagtcgttactacttttgtggataatgatgatttcgattttgatgatgaattatcaaagtggtggaatgatactaagcatgaactaccagactttgattatttcaattacacagtacctattttgaatattagtagtgaaattgatagaattcaaggtgtcatacaaggtcttaatgattctttgatcgaccttgaaacactatcaattctcaaaacttatattaaatggccttggtatgtctggcttgccataggttttgcagttattatattcatcctaatattgggatgggtgtttttcatgactggttgttgtggttgttgttgtggatgctttggtatcattcctctaatgagtaagtgtggtaagaaatcttcttattacacgacttttgataatgatgtggtaactgaacaatacagacctaaaaagtctgtttaatgattcagaatccaacatcttttctaatagtgttaattcttctttggtttaaacttgtgctaagttgttttagagattgtgtgttagcactcctacaactaatacaagttctactccaaattattaatagtaatttacaatctaggctgctcctttggcacagcctagactaatgttagattttgagaaaataattgaaactggtgaagtagtaatacaacaaatcagtttcaaattacaacatatttcaagtgttctagaaacacaaatttttgacccatttgagtgttgctattattcaagtggtagtttttatgaaatagagtcagctgacgattgttcagatgaatatactgactaaatcgctagaagagaacggcagttttccaacagccctttatgtatttttggcatttgtagcactttatcttttaggtagagcactacaagctttcgtacaagcagctgatgcttgttgtttattttggtatacatgggtagtagttccaggagctaagggtacagcctttgtatacaagcatacatatggtagaaaacttaacaatccggagttagaacacgttattgttaacgagttcccaaagaacggttggaataatgatagccctgcaatttttcaggatgtcgatcggcacggaaaattgcactcttagtactcagcaagcggctgagcttttcaaagaatacaatctatttataaccgcattcctattgtttcttactatactacttcagtatggatacgcaactaggagtcggcttatttacatactgaaaatgatagtgttatggtgcttctggccccttaacattgcagtaggtgtaacttcatgtatatacccaccaaacacaggaggccttgttgctgcaataatactcactgtgtttgcgtgtttatcttttataggttattggattcagagcattagactctttaagcggtgtaggtcttggtggtcttttaaccccgagagcaatgccgtaggttcaatactcctaacaaatggtccacaatgtaattttgctatagagagtgtgccaatggtactttctcctattattaagaatggtgctctttattgtgaaggtcagtggcttgctaaatgtgaaccagatcacttgcctaaagatatatttgtatgcacaccagatagaagaaatatctatcgtatggtgcagaaatacactggtgaccaaagcggaaataagaaaaggtttgctacatctgtatatgccaaacagtcagtagatactggcgagctagaaagtgtagcaacaggaggaagtagtctttacacataaatgtgtgtgtgtagagagtacttaaatttattctttaatagtgcctctattttaagagcgcataagagtatttattttgaggatcttaatataaatcctctttgtttcatactctcctttcaagagttattatttaaagaacagtttttccactcttttgtgccaaaaactattgttgttaatggtgtgtgtttccaagtagataatggaaaagtctaccacgaaggaaaacccatttttcagaaaggttgttgtaggttgtggtcccattataagagggattagaataattaaaccaccaacaacaatttcttgtattaaaggtgtttgggtttacaaacgcttaaaagaaacaaatacggaatgaaatggttgtctagtttaggacgagcatttatttccttttataaatccctactattaactcaactcagagtattagataggttaatcttagagcacggaccaaaaagtacattaacgtgtgctaggcgagtgcttttagttcaattagatttagtttataggttggcatatactcccaaccagtcgctggtatgaataatagtaaagataatccttttcgcggagcaatagcaagaaaagcgcgaatttatctgagaggaggattagattgtgttcaacttaacaaagcaggacaagcagagccttgtcccgcgtgtacctccctagtattccaagggaaaacttgtgaggaacacatagataataataatcttttgtcatggcaagtcgtaagacagctgaaaagtcagatgccccgacaccaatcatcaaactaggagggcctaaaccaccaaaggtagggtcatctggaaatgcatcttggtttcaagccttaaaggccaagaaactaaatgcacctgcacctaagtttgaaggtagtggtgttcctgataatgaaaatctaaaaccaagcctgcagcatggatactggagacgccaagccaggtataagccaggtaaaggtggaagaaaaccagtccctgatgcgtggtacttttactacactggaacaggaccggccgctgacctgaattggggtgattctcaagatggtatagtgtgggttgctgcaaagggtgctgatgtaaaatctagatccaatcagggtacaagagaccctgacaagtttgaccaatatccactacgattttccgatggaggacctgacggtaatttccgttgggatttcattcctctgaatcgtggtaggagtggaagatcaactgcagcttcatcagcagcatctagtagagcaccttctcgtgaaggttcacgtggtcgtaggagtggagctgaagaagacttgattgctcgtgcggcaaagattattcaggaccagcaaaggaagggtacgcgcattatcaaggcaaaggcagatgaaatggctcaccgtcgattctgtaagggtaccattccacctggttatagagtagatcaaggatttggccctcgtactaaaggtaagaagggaaattttggtgatgacaagatgaatgaggaaggtattaaggatgggcgtgttacagcaatgctcaaccttacacctagccctcatgcttgtctttttggaagtagagtgacgcccaagcttcaaccagatgggcttcaccttagatttgaatttactactgtggtgcctagagatgacccgcagtttgataattatgtaaaaatttgtgatcagtgtgttgatggtgtgggaacacgtccaaaggatgatgaaccaagaccaaaatcacgctcaagttcaagacctgcaacaagagcaagttctccagcgccaaaacaacagcgccctaagaaggagaaaaagccaaagaagcaggatgatgaagtggataaagcattgacctcagatgaggagaggaacaatgcacagctagaatttgatgatgaacccaaagtgattaattggggtgattcagcacttggtgaaaatgaactttgattaacataatggacttgctgcattttatgtggcattgctgttgttattattgctctgcttttctctcaatcattatgggctttgattgtgatcatgtgcagtaccttagttggtttcccttgttgtttgcagtttgtcttctttctgtgcttattgtttttattctgctttattctttgttatatcgtagaagtttattaaaggttaaggaagataggcatgtagcttgattacctacatgtctatcgccagggaaatgtctaatctgtctacttagtagcctggaaacgaacggtagacccttagattttaatttagtttaatttttagtttagtttaagttagtttagagtaggtataaagatgccagtgccggggccacgcggagtacgatcgagggtacagcactaggacgcccactaggggaagagctaaattttagtttaagttaagtttaattggctaagtatagttaaaatttataggctagtatagagttagagcaaaaaaaaaaaaaaaaa

SEQ ID NO: 19 - DNA, 19940 bp, Coronavirus
atggcttcaagcctaaaacagggagtatcttcccaaaaccagaggagtgtcgttcttgttgccaaagacattcccgaccaactccgtgacgctttgtttttctatacgtcacacaacccaaaggattacgctgatgctttcgcctataggcagaagtttgatcgtaatctgggggctgggaaaaagtttaaatttgaaactgtgtgtggttcattctttttgcaaggagtggacaaaataacacctggtgtcccagccaaagctttaaaagccacttctaggttggcagatttggaagacatctttggtgtctcacctctagcacggaaataccgtgaactccttaaaacagcatgccagtggtctctaacagtagaatcaatggatgctcgtgcacaaactcttgaagaaatctttgactcggctgaaatactttggcttcaggttgcagcaaagatccaggtttcggctatggcaatgcgcaggcttgttggtgaagtaactgcaaaggtcatggatgctttgggctcaagtctgagttctcttttccaaattgtgaaacagcaaatagtcagaatctttcaaaaggcactggctatttttgggaatgtgaaagatttgccacagcgtattgatgcactcaagatggcttttgccaagtgtgcaagatcaattacagttgtggttgttggacatgctctcactatcagagagtttgctggaacttgtcttgcaagcattaatggtgcagttgcaaaattctttgaagaacttccaactggttttatgggtgctaaggtcttttcaactcttgccttctttaaagaagcagcagcaaagatcgtagaaaacataccaaatgcgccaagaggtactaaaggtttcgaagtcgttggcaatgccaaaggtacacaagttgttgtccgtggcatgcgaaatgacttaactctgcttgatcaaaaagctgaagttcctgtggaaccagaaggttggtctgcaattttggagggacatctttgctatgtctttaagagtggtgatcgcttttatgcggcacctctttcaggaaattttgcattgcatgatgtgcattgctgcgagcgtgtagtctgtctgtctgatggtgtaacaccggagataaatgatgggcttgttcttgctgcaatttactcatcttttagtgtttcggaacttgtggcagcacttaaaaaaggtgaaccattcaagttcttggggcacaaatttgtttatgtgaaggaagcggcagtttctttcaccttggcaaaagcagcaaccattggagatgtcctgaagctgtttcaatcagcaagagtaaagacggaagatgtgtggtctgcacttactgaaaagtcttttgaattctggaaacttgcgtacagaagagtgcgcaatcttgaagaatttctgaagactcatttttgtaaagctcaaatgtcaattgtgatcctagcagcagtgcttggtgagggcatttggcatctttgttcacaagtcatctataaattgggtggtttgttttctaaagttgttgacttttgtgcaatacactggaaaggtttttgtgaacaattgaagaaggctaagcttcttgtcactgagcacctatgtgtcctgaaaggtgttgcacagcattgttttcaacttttgctggatgcaatacattctatgtacaagagttttaaaaagtgtgtacttggtagaatccatggagacttactcttttggaaaggaggtgtgcataaaattgtccaagaaggcgatgaagtttggttcgacaccatagatagtgttgatgttgaagatctgggtcgtgtccaggaaaaacctgtagattttgaggtttgtgatggtataacacttccagaaaatcaacctggtcatatggtccagtttgaagatgatggaaagaactatatgttcttccgcttcaaacgtgaggacagtgtttattacgcaccaatgtcacaacttggtgcaattaatgttgtttgcaaagcaggtggtaagactgtcacgtttggtgaaactacagtgcgagaaataccatcacctgatgtggtgcctattaaggttagcattgagtgttgtggtgaaccttggaacactatctttaagaaggcttataaagagcccattgaagttgaaacagacctcacagtagaacaattgctcgctgtgatctacgagaaaatgtgtgacgacctcaaattgttcccagaggctccagaacctccaccatttgagaatgtagcacttgttgataagaatggtaaagatttggattgcataaaatcatgctaccttatctaccgtgattatgagagtgatgatgacatcgaagaggatgacgctgaggagtgtgacacagcttcagataatgctgaggaatgtgaaacaacttcggagtgtgaagaagaggatgaaggtacaaaggtgttggctctcatacaagacccagcaagccaaaaataccctctgcctcttgatgatgattacagtgtctatagtggatgtatagtccataaagacgctctcgatgttgtgaatttaccatctggtgacgaaacttttgttatcaacaattgttttgatggcgctgtaaaagaactcccaaagtcagttgtagatgttctaagtgactggggtgcagccgtcgatgcacaggagaagtccttgaatgacgtagctgattccagtagtgtaccagtgccggaggaagatccggtagttagtactaatgtaattcatgaacaggaggtcattcctgttgtagaagaagagcaaagtgtcgttgtcttcacacctgctgaagtcgatgttataaaagaaacaccagatgaatttattctcattccggaagtttctgttgttgaagaagcaattcctgttagcagagaagatgaagtaacttcgcaacaggatgaatttaaagatttttctcgagttgaagatgcaagtggtgcacaacaggaagaatctaaaattgaagagcctcctcaagctgtaaaaacacaacgtgagaagagggctaagaagtttaaagtcaaagtaaccacacaaaaagctcctagttgtttggagtataaaacttgtgtgggtgatttaactgttgtgatagccaaggcattggatgagtttaaagagttctgtgttgtaaacgccgcaaatgagcatatgtctcatgggggtggcgttgcaaaagcaattgcagacttttgtggtccagattttgtggagtattgtgaagactatgttaagaaacatgggccacaacagagacttgtcacaccttcttatgttaaaggcattcaatgtgtgaacaatgttgtaggtccacgccatggggacagtgacttgtttcaaaaactggttactgcgtacaagaatgttattgttgatggcgtggtcaattatgttgtaccagttctctcatctggaatttttggagttgattttaaattgtcaatagatgctatgcgtgcggcctttgatggttgcaacatacgtgtccttctcttttctctgaatcaagaacacatcgaatatttcgatgcaacttgtaagcagaagacaatttatcttacagaagatggtgttaaataccgctctgtagttgtgaaacctggagactctttgggtcagtttggacaggtttttacaagacacaagactgtctttacggctgatgatgttgaagataaagaaattctctttgttccaactactgacaaggctgttcttgattattatggtttggatgcgaaaaagtatgtgatatatttacatacgctttcacaaaagtggaaaatcctagttaaggataattttattcaacttgagtggcgtgatggaaattgctgggttaattcagcaatagtaatccttcaggctgctaagattaagtttacaggttttcttgcaggagcatgggctgctctgttgggtggagatcccacagactttgtagcatggtgttatgcaagttgcaatgctaatgttggtgaattttcagacgctaattggctcttggccaatttggcagaacattttgatgtagattacacgaatgcacttcttaagaagtgtgtttcttgtaattgtggtgttaagagttatgagtttagaggccttgaagcttgcattcagccagtaaaggcacctaatctactacattttaaaacgcaatattcaaattgccccacttgtgattcaaatagtgtagatgaagttgtagaagcttctctcccatatttgcttcttctagcgacggatgggcctgctgcagtagattgtgatgatagtgctgcaggaaacatagtgttcataggttccactaacagtggtcattgttatacacaagccgttggtaaggcttttgataatcttgctagtgatagaaaatttggaaagaagtcgccttacattacagcaatgtatatccgcttctctcttaaaagtgaaaattctatgcctgttgctaacaagagcaaaggtaaaggtcaagtagtaaaagaagatgttgctaactttgctattagttcaaaagtcagttttgataatcttactgactttgagcagtggtatggtagtaacatttatgagagtcttaaagtgcaggaaacatctgacaatcttgatgattatgtgtcatttacaacaaaggaagattccacgttgccactgacacttaaagttcgtggtattaaatcagttgttgattttaagtcaaaggatggctttacttataaattaacacctgatattgatgaaaattcaaaggcacctgtttactacccagtcttagactctgttagtcttagagcaatttgggtagaaggtaatgctaattttgttgttggacatccaaattataatagtagagccttgcgaattcccactttgtgggattgtgcagagagttttgttaaaattggtgaaaaggttaatggtgttactatgggcctatggcgtgcagaacaccttaataaacccaatttggagacgcttttcaatatcgttaagaaaacgattgttggaactaatattgttactacccagtgtggtaaaataatttctaaggctacatcatttatagctgataaagtaggagatggtgtagttcgcaatgttactgatagaattaaagggtgttttgggtttactagggagcattttgaaagaagagtgtctccacagttcttaaaaaccctctttttcttcttcttctgtcttctgaaggctagtgctaagagtttaatgtctagctacaagagtgtgctacgtaaagtggtatttactgctttacttataatatggtttgtctacacaagcaacccagtaatgtttactgggatacgtgtgttagatttcctatttgaaggttcattctgtagtccttatgcagattacggcaaagaatcttttgatgttttacgctattgcggaagtgatttcacttgccgtgtttgtttacatggtagggattcgctacatttgtataaacatgcctatagcgtagaacagttttataaagatgcagttaatggcatcagttttacatggaattggctttatatgctgttcctaatactctttgttaagccagtggcaggttttgttattatttgctactgtataagatatttggttttaagcacaactgtattgcaaactggtgtaggatttttagactggtttattcaaacagtgtttgctaactttaattttatgggggcagggttttatttctggctcttttataagatatatatacaggtgcatcatataatgtactgtaaggatataacatgtgaagtttgtaagagagttgcgcgcagtaatagacatgaggttagtgtagttgttaatgggcgtaaacagcttgtccacgtctacactaactcaggttacagtttctgtaagagacataattggtactgtaagaattgtgacaagtatggtcatcaaaacacatttatgtctcctgaagttgctggtgagctttcagaaaagcttaaacgtcatgttaaacctacagcacatgcataccacgtagtggatgatgcatgcttagttgatgactttgttaatctgaagtacaatgctgccaccccaggtaaagaaggtgtgcattctgctgttaaatgttttagtgtatctgatttcttaaagaaagcagtctttcttaaggatgcacaaaaatgtgaacaaatatctaatgatagttttatagtttgtaatacacacagtgcgcatgcattagaggaagctaaaaatgcagccatctattatgcgcaatgtctttgtaaaccaattcttatacttgatcaggctctttatgaacaattgattgtagaacctgtgtctaagagtgttgtagacaaagtgtgtaatgttttgtctaatataatatctgtagattctgcagctttgaattataaggctggcacacttcgtgatgccctcctttctgttactaaggatgaagaagctgttgatatggctatcttctgccataacaatgatgttgaatatactaatgatggttttactaatgtggtgccatcatatggtatagacactgataagttaacacctcgtgatagaggctttttgataaatgcagatgctgccattgctaacttgaaagtgaaaaattcaccgccagtagtgtggaagtattctgaccttattaaactgtctgacagttgtcttaagtatttaatatcggcaactgtaaagtcaggaggtaggtttttcataacgaggtctggtgctaaacaagttattgcttgttatactcagaagttgttagtggaaaagaaggctggtggtgttgttagtaacactgttagttggtttaggagttgttgtaaatggctcttagtgttctatttactttttacagtgtgttgtttgggttactatcaatgggaaatgagtagagaatttcctcatcccatgtatgattttaattccacaatgcatgtagaagggtttaaggttatagataagggtgtacttagggatattatgccagaagacacttgcttctctaataagtatgttaattttgactcattttggggaaaaccttatgtaaatagtagagactgtcctattgtaaccgctattatagatggtgctggaacagtagctgctggttctcctggttttgtacagtgggtcatggatggtgtaatgtttatccatatgacacaaactgagcgaagaccttggtatattcctacttggtttaatagagaaattgttggttacactcatgattctattgttacagaaggtgagttttatacttccatagcattgtttgcttctagatgtttgtatttaacatctagtaacacaccacagctttattgctttaatggtgatagcgatgctcctggtgcattaccgtttgcaaatatactccctcatagggtatattttcaacctaatggagttaggcttattgtgcctcagcaaattatgcatacaccatacatagttagacttgtttcagatagctattgtagaggtagtgtttgtgaatatactaaaccgggttattgtgtttcaatgaattcccaatgggttttgtttaatgatgaatacacaagtaaaccaggtgtgttttgtggcgctactgttagagaacttttgtttagtatggttagtacattctttactggtgttaatccaaatatttatatgcaattggcaactatgttcttaatacttgttgctgttgttttagtttttgcaatggttataaagtttcaaggtgtttttaaagcttatgcaaccactgtatttactataatgcttgtttgggttattaatgcatttgtgttatgtgtgcatagttataataatgttttagctattatactacttgtgctttattgttatttatcacttgtgacgagtcgtaacactgctataataatgcactgttggcttgtcttcacatttggtttaatagtacctagttggatagcttgtgtctacttaggttttgtattatatatgtatacaccgctggttttgtggtgttatggtacaactaagaattgccgtaagctttatgaaggcaatgagtttgttggtaattatgacctcgctgcgaagagtacttttgtaattcgtggccctgaatttgttaaacttactaatgagataggcgataaatttgacgcctacctctcagcgtatgctagacttaaatactattcaggtactggcagtgagcaagattacttgcaagcctgccgtgcatggttggcttatgcactagatcaatttagaagcagtggtgtagaagtagtgtataccccaccacggtattctattggtgttagtagattacaggctggttttaagaaactagcagctcctagtagcgctgttgagaagtgcattgttagtgtgtcctataggggtaataatcttaatggattgtggttgggtgattctatttactgtccacgtcatgtgttaggtaagtttagtggtgatcaatgggatgacgtacttaatcttgctaataatcatgagtttgaagttgtaactggaaatggtgttactttggctgttgtcagtaggcgtttgagaggtgcagttttgattttacaaactgcaattgctaatgctgaaactccaaagtataaattcatgaaagcaaattgtggtgacagttttaccattgcttgctcttatggtggtacggttataggactttaccctgtcactatgcgttctaatgggactattagagcgtcttttcttgccggagcatgtggttcagtaggttttaatatagaaaggggtgtagtaaatttttactatatgcaccatctagaattgcctaatgcattacacactggaactgatctaaatggtgcgttctatggtggttgtgttgatgaggaggttgcacagagagtgccaccagataaccttgttactaacaacattgttgcatggctttatgctgcaattattagtgttaaagagagtagtttttcaacgcctaaatggcttgaaagtactactgtcagcgttgatgattataataagtgggctggtgataatggttttacaccgttttcaactagcactgctatcactaaattaagtgctataacgggagttgatgtttgtaaactccttcgcactattatggttaagtctagtcaatggggcaatgaacccattttaggccaatataattttgaggatgaactaacaccagaatctgtttttaaccaggttggtggtgtcagactacagtcttcttttgtgaaaagagctacatcttggttttggagtagatgtgtgttagcttgtttcttatttgttttgtgtgctattgttttgtttacggcagtgccacttaaatattatgtgcatgcagctgttgttttgttagcggctgttacatttatctcttttactgttaaacatgttatggcatatatggatactttccttttgccgacattgattacagttattattggagtttgtgctgaagtacccttcatttacaatactctaattagtcaaattgttattttctttagccaatggtatgatccagtagtgtttgatactatggtaccatggatgttcttaccattagtgctgtacacagcttttaagtgtgtacaaggttgctatagtgtaaattctttcaatacttctctgttagttttgtaccagtttatgaagttggggtttgttatctatacctcttctaacactgttactgcatactcggaaggtaattgggagctattctttgaattagtacacactactgtgttggctaatattagtagcaattccttaattggtttatttgtatttaagttggctaaatggatgctgtattattgtaatgcaacatactttaataattatgtgctaatggcagtcatggttaatggcttaggttggctctttacttgttactttgggttttattggtgggttaataaggtttttggtttaaccttaggcaaatataatttcaaagttccggttgatcaatataggtatatgtgtcttcataagataaaaccacctaaaactgtgtgggaagtcttttcgacaaatatacttatacaaggtataggtggtgagcgtgtgcttcctatagccacagttcaatctaaattaagtgatgtaaaatgcacaacagttgtcttaatgcagcttttgactaagcttaatgttgaagcaaattcaaaaatgcatgcttatcttgtagagttgcacaataaaattcttgcctctgatgatgttaatgagtgcatggataatttgttgggtatgcttgtaacactattttgtgtagatagtactattgatttaagtgagtattgtgatgatatacttaagagattaactgttttacagtcagttactcaggagttttcacacataccttcttatgcagaatatgaaagagctaaaaacctctatgaaagggtgttagctgattctaaaaatggtggtgttacacagcaagaacttgctgcatatcgtaaggctgccaatattgcaaagtcggtctttgatagagacttggctgtacaaaagaagttagatagcatggcagagcgcgctatgacaacgatgtataaggaagcgcgtgttactgatagaagagcgaaacttgtttcttcattacatgcgctgttattttctatgcttaagaagatagattctgaaaagcttaatgtactattcgaccaggcaagcagtggtgttgtgccactagctactgttcctatagtttgtagtaataagcttactcttgtagtgccagacccagaaacatgggtcaagtgcgtagagggcatgcatgttacatattcaacagttgtttggaatattgataatgttactgacgcagatggcactgaattgcaaccaatttctacaggtaatggtttaacatactgtataagtggtgataatatagcatggccccttaaggtcaatttgactaggaatgtgcataacaaagttgatgcagcattgcagaacaacgagcttatgcctcatggtgtaaaaacaaaggcatgcgtggcaggtgtagatcaagcacactgcagcgtagagtctaaatgttattatactaatattagtggtaattcagtagtggctgctattacctcctcaaatcctaatttgaaagtcgcctcatttttgaatgaagcaggcaaccaaatctacgttgacttagacccaccatgtaaatttggtatgaaggtgggtgataaagtagaagttgtttacttgtattttataaagaatacaaggtcaattgttaggggtatggtacttggtgctatatctaatgttgtagtgttacagtctaaaggacatgagacagaggaagtggatgctgttggcatattatcactttgttctttttcagtggatccagctgacacgtattgtaagtatgtagcagcaggtaaccaacctttaggtaactgtgttaaaatgttgacagttcataatggtagtggctttgctataacatcaaagccaagtccaactcctgatcaggattcttatggaggagcttccgtgtgtctctattgtagagcacatatagctcacccaggaagtgcaggaaatttagatggacgttgtcaatttaaaggttcttttgttcaaatacctactacggaaaaagaccctgtagggttctgtctacgtaacaaggtttgcactgtttgtcagtgttggataggtcatggatgtcaatgtgattcacttagacaaccaaaacctttggttcaatcagatgctggtgcatctggttttgataagaattatttaaacgggtacggggtagcagtgaggctcggctgataccccttgctaatggatgtgatcctgatgttgtaaagcgagcctttgatgtatgtaacaaggaatcagccggtatgtttctaaatttgaagcgtaattgtgcgcgattccaagaggttcgcgatactgaaggtggaaatcttgagtattgcgattcttattttgtggttaaacagaccactcctagtaattatgaacatgagaagtcttgttacgaagacttaaagtcagaagtaacggctgatcatgatttctttgtgttcaataagaacatttataatattagtaggcaacgacttactaagtatactatgatggacttttgttatgctttgaggcattttgacccaaaggattgcgaagtttttaaagaaatacttgtcacttatggttgtatagaagattatcaccctaagtggtttgaggaaaataaggattggtacgacccaatagaaaacccaaaatattatgctatgttggctaaaatgggccctattgttcgtcgagcactattaaatgctgttgagtttggaaacctaatggttgaaaagggttatgttggtgtggttacactagataaccaagacctcaatggcaaattttatgattttggtgattttcaaaaaacagcacctggtgctggtgttcctgtttttgatacatattattcttacatgatgcccatcatagccattacggatgctttagcacctgaacggtattttgaatatgatgtgcataagggttataagtcttatgatctcctcaagtatgattatacagaggagaaacaagaattgtttcagaagtactttaagtactgggatcaagagtaccaccctaattgttgtgattgtgcagacgataggtgtttgatacattgtgcaaacttcaatgtacttttctctacactgataccacagacttcttttggtaatttgtgtagaaaggtctttgttgatggtgtcccttttatagctacttgtggctatcattctaaggaacttggtgttattatgaatcaagataacaccatgtcattctcaaaaatgggcttaagccagcttatgaaatttgtaggagatcctgcccttttggtaggaacttctaacaatttggttgatcttagaacttcttgctttagtgtctgtgcattagcttctggtataacacaccagacagttaagccaggtcactttaataaagatttctatgattttgctgaaaaagcaggtatgtttaaggaagggtcatcaatcccacttaaacacttcttctatccacagactggtaatgctgctataaacgattatgattattatcgttataacaggcctactatgtttgatatacgccagcttctattctgtttagaggtgacgtctaaatattttgactgttatgaaggtggttgtataccagctagtcaagtggttgttactaaccttgataagagtgcaggctttccatttaataaatttggaaaagctcgtctttattatgaaatgagtctagaagagcaggaccaactctttgaaagtacaaagaaaaatgtcctacccactataactcagatgaatcttaaatatgccatatccgcgaaaaatagagcgcgtactgtggcaggtgtgtcaattctttctactatgactaatagacaatttcaccagaaggtgcttaagtctatagtcaatactagaaatgcttctgtagtaataggaacaaccaaattttatggtggttgggataatatgttaagaaaccttattcaaggtgtggaagacccaatgcttatgggttgggattatcctaagtgtgatagagcaatgccaaatttgttgcgtatagcagcgtctttggtgcttgcccgtaaacacaataattgttgcacatggtctgagcgcatttatagattgtacaatgagtgcgcccaagtattgtctgaaactgtattagctacaggtggtatttatgtaaagcctggtggtactagcagcggagatgctaccactgcttatgccaacagtgtttttaatataatacaagccacatctgctaatgttgcgcgtttgcttagtgttataacgcgtgatatagtatatgatgacattagaagcctgcagtatgaattataccagcaggtttatagacgagtcaattttgatgcagcctttgtcgaaaagttttattcttacatgtgtaagaatttttcattaatgatcttgtctgatgatggtgttgtttgttataacaacacacttgccaaacaaggtcttgtagcagatatttctggttttagagaaattctctactaccaaaataatgtttatatggcagattctaagtgctgggtggaaccagatttagaaaaaggcccacatgaattttgttcacagcacacaatgctagtagaggttgacggagagctaagatatttgccatatccagacccctcacgcatttttggtgcatgtgtttttgtagatgacgtggataaggctgggcctgtggctgttatggagcgttatatagctctcgccatagatgcttacccgcttgtacatcatgaaaatgaggagtataagaaagtcttctttgtactcctttcttatattagaaaactctatcaggagctctcccaaagtatgcttattgactactcctttgttatggatgtagacaagggtagtaagttttgggaacaggagttctatgagaatatgtacagagccccaacaaccttacaatcttgtggtgtttgtgtagtttgtaatagtcaaactatactacgctgtggtaattgtattagaaaaccattcttgtgttgtaaatgttgttatgaccatgtcatgtatactgaccacaaaaatgttttgtctataaacccatacatttgctctcaacctggttgtggtgaagcagatgttactaaactttacctcggaggtatgtcctacttctgtggtaatcataaacctaaattatcaataccgttagtatctaatggtactgtttttggaatttatagggccaattgtgtaggtagtgaaaatgttgatgattttaatcaactagctactactaattggtctaccgttgaaccttatatattagcaaatcgctgtagcgactcattaagacgctttgctgctgagactgtcaaagcaacagaagagttgcataaacagcaatttgctagtgcagaagtcagagaggttatttctgaccgtgaattaattctatcgtgggaacctggtaagactagacctcccttgaatagaaattatgttttcactggctatcactttaccaggacaagtaaggtacagctaggtgattttacttttgagaaaggtgaaggtagagatgttgtctattatagggcgacgtctacagctaaattgtctcctggagatatctttgtcttaacatcacacaatgttgtttctcttgtagcaccaactttgtgtcctcaacaaaccttttccaggtttgttaatttaagacctaatgtaatggtaccggagtgttttgttaataacattccattataccatttagtaggtaaacaaaagcgtactacagtacaaggccctcctggcagtggtaagtcacactttgccataggccttgctgcatactttagtaatgctcgtgttgtttttacagcatgttctcatgctgcagtagatgcgctttgtgaaaaagcgtttaaatttcttaaagttgatgattgcactcgcatagtacctcaaaggactactgttgactgcttctcaaaatttaaagctaatgacacaggcaaaaagtacatttttagtactattaatgccttgccagaagttagttgtgacattctgttggtagatgaggttagtatgttgaccaattatgaattgtcatttattaatggtaagataaattaccagtatgttgtgtatgtaggtgatcctgcccaattaccggcacctcgtactttgcttaatggttcactttcacctaaggattataatgtcatcacaaatcttatggtttgtgttaaacctgacattttccttgcgaagtgttatcgttgtcctaaagaaattgtagacactgtttctactcttgtctatgatggaaagtttgttgcaaataacccagagtcacgtgagtgtttcaaggttgtagttaataatggtaattctgatgtaggtcatgaaagtggttcagcctacaacacaacacagttggaatttgtgaaagattttgtttgtcgcaataaacaatggcgagaagcaacatttatttcaccttataacgccatgaatcagagagcctaccgcatgttgggacttaatgtccagactgtagactcatcacagggttcagagtatgattatgttatattctgtgtcactgctgattctcagcatgcgctgaatattaacagatttaatgttgcgcttacaagagctaagcgtggtatacttgttgtcatgcgtcagcgtgacgaattgtatgccgctcttaaatttacagagcttgatgctggggcaagcctgcaaggtacaggtttgtttaaaatttgcaataaggagtttagtggagtacatcctgcttatgctgtaaccactaaagcgcttgcggcaacgtacaaagttaatgacgaactagcagcacttgttaatgtagaagctggttcagaaataacttataagcatcttatttctctgttagggtttaagatgagtgttaatgttgaaggttgtcataacatgtttataacacgtgacgaggcaatccgcaatgtaagagggtgggtaggttttgatgtagaagccactcatgcttgtggtactaacattggaaccaaccttccatttcaagtaggattctctactggtgctgactttgtagtcacacctgagggtcttattgatacctcaataggcaataattttgagcctgtaaactctaaagcacccccaggtgaacaatttaatcacttgagagctttgtttaagagtgctaagccttggcatgttataagaccaaggatagttcagatgttagcagacaatctatgcaatgtttcagattgtgtagtgtttgtcacatggtgtcatggcctagaactaactactttgcgctattttgttaaaataggcaaggaacaagtttgttcttgtggttctagagctacaacttttaattctcacactcaggcttacgcttgttggaggcactgcttgggtgtctataatccacttttagtggatattcaacaatggggttactctggtaatctacagtttaatcatgatttgcattgtaatgtgcatggccacgctcatgtagcttcagctgatgctgtaatgacccgctgccttgcaattaataatgcattctgtaaagatgtcaactgggaactgcagtaccctcatattgcaaatgaggatgaagtaaattccagttgcaggtatctacaacgcatgtatcttaatgcgtgtgttgatgctcttaaagtcaatgttgtctatgatataggcaaccctaaaggtataaaatgtgttagacgtggggatgtcaattttaggttctatgataagaacccaattgtacctaacgtcaaacagtttgagtatgactatagtcagcataaagataagtttgctgatggtctttgtatgttttggaattgtaatgtggattgttatcctgaaaattcattagtttgtaggtatgacacacgaaatttgagtgtgtttaacctaccaggctgtaatggtggtagcctgtatgttaataaacatgcattccacacacctaagtttgatcgcattagctttcgtaatttgaaagctatgccatttttcttctatgattcatcgccttgcgaaaccattcaggttgatggagtagcgcaggaccttgtttcattagcaactaaagattgtatcacaaaatgcaacattggtggtgctgtttgtaagaaacacgctcaaatgtatgcagaatttgtgttttcatataatgcagctgtcacagctggttttactttttgggttactaataattttaacccttataatttatggaaaaatttttcagctctccagtctattgacaatattgcttttaatatgtataagggtgggcattacgatgctattgcaggcgaaatacccacagtcataactggagataaagtttttgttattgatcaaggtattgaaaaggcagtttttgttaatcaaacaactctgcctacatcagttgcatttgagttgtatgcgaaaagaaacattcgcacactgccaaacaacagaatattgagtggtttaggtgtagacgtgacccacggttttgtaatttgggattacgctaaccaaacaccattatatcgtaatactgttaaagtttgtgcatacacagacattgagcccaatggcttaatagttctgcatgatgatagatgtggtgattaccaatcttttcttgccgctgataatgctgttttagtgtctacacagtgttataagcggcatccttatgtagaaataccatcaaatctgcttattcagaatggtatgcctctaaaagatggagcgaacctgtatgtttataagaggagtaatggagcgtttgtgacgctaccaattacacttaacacacagggtcgtaattatgaaacttttgaacctcgtagtgatgttgagagagatttccttgacatgtctgaggatgattttgttgaaaagtatggtaatgacttaggtctacaacacatactttatggtgaagttgaaaaaccacaattgggtggtttacacactgttattggtatgtacaggctattgcgtgaaaataagttaagcgcaaaatctgtcactaactcagattcagatgtcatgcaaaattattttgtactgacagataatggttcttacaagcaagtttgtactgttgtagacctattgctagatgatttcttagaacttcttaggaacatacttaaagagtatggtactaataagtccaaagttgtaacagtgtctattgattaccatagcataaattttatgacttggtttgataatggcagtattaaaacatgttatccacagcttcaatcagcgtggacgtgtggttataatatgcctgaactctacaaggttcagaattgtgttatggaaccttgcaatattccaaactatggtgttggaattacattgccaagtggtattatgatgaatgtggcaaagtatacacaactttgtcagtatctttctaagactacaatgtgtgtgccgcataatatgcgtgtaatgcactttggagctggtagtgataaaggagtagcaccaggcagcactgttcttaagcagtggctgcctgagggaacactccttgttgataatgatattgtagattatgtatctgatgcacatgtttctgtgctttcagattgcaataaatataaaacagtgcacaagtttgaccttgtgatatctgatatgtatacagataatgattctaagggaaaacatgaaggcatagtagccaataatggcaatgacgatgtcttcatttatctatctaattttttaaagaacaacttagctcttggtggtagttttgccattaaagttacagagacaagttggcatgagagtttatatgacatcgcacaagattgtgcatggtggacaatgttttgtacagcagtaaatgcttcttcttctgaagcatttttactgggtattaattatttgggtgcaagtggaaaagtgaaagtaagtggaaaaactctgcacgcaaattatatattttggcggaattgtaattatttacaaacctctgcttatagtatatttgacgttgctaagtttggattaaaactaaaagcaacgccagttgtaaatttgaaaactgaacaaaagaccgacttagttgttaatctactaaggaacggcaagttattgattagagatgttggggaagtcactgtttttagtgaccattttgtgtgcactatgtag

SEQ ID NO: 20 - DNA, 27528 bp, Coronavirus
tgcactttagtgccctggatggcacctggccatctgtcaggttttagttattagattctattgttgctagtatcactgcttgttttgttgtgtctcactttatacatccgttgcttgggctacctagtgccagcgtcctgcagacgctgtggtcggttcgagtgcgaggaacctctggttcatctagcggtacgcgggtgtgtggaagtagcgcttcaggcgtacgtgttcctgttgcgtgtaacacggggtcacctccccccacattcctctaagggcttttgagcctagcgttgggctacgttctcgcataaggtcggctatacgacgtttgtagggggtagtgccaaacaacccctgaggtgacaggttctggtggtgtttagtgagcagacatacaatagacagtgacaacatggcttcaagcctaaaacagggagtatcttcccaaaaccagaggagtgtcgttcttgttgccaaagacattcccgaccaactccgtgacgctttgtttttctatacgtcacacaacccaaaggattacgctgatgctttcgcctataggcagaagtttgatcgtaatctgggggctgggaaaaagtttaaatttgaaactgtgtgtggttcattctttttgcaaggagtggacaaaataacacctggtgtcccagccaaagctttaaaagccacttctaggttggcagatttggaagacatctttggtgtctcacctctagcacggaaataccgtgaactccttaaaacagcatgccagtggtctctaacagtagaatcaatggatgctcgtgcacaaactcttgaagaaatctttgactcggctgaaatactttggcttcaggttgcagcaaagatccaggtttcggctatggcaatgcgcaggcttgttggtgaagtaactgcaaaggtcatggatgctttgggctcaagtctgagttctcttttccaaattgtgaaacagcaaatagtcagaatctttcaaaaggcactggctatttttgggaatgtgaaagatttgccacagcgtattgatgcactcaagatggcttttgccaagtgtgcaagatcaattacagttgtggttgttggacatgctctcactatcagagagtttgctggaacttgtcttgcaagcattaatggtgcagttgcaaaattctttgaagaacttccaactggttttatgggtgctaaggtcttttcaactcttgccttctttaaagaagcagcagcaaagatcgtagaaaacataccaaatgcgccaagaggtactaaaggtttcgaagtcgttggcaatgccaaaggtacacaagttgttgtccgtggcatgcgaaatgacttaactctgcttgatcaaaaagctgaagttcctgtggaaccagaaggttggtctgcaattttggagggacatctttgctatgtctttaagagtggtgatcgcttttatgcggcacctctttcaggaaattttgcattgcatgatgtgcattgctgcgagcgtgtagtctgtctgtctgatggtgtaacaccggagataaatgatgggcttgttcttgctgcaatttactcatcttttagtgtttcggaacttgtggcagcacttaaaaaaggtgaaccattcaagttcttggggcacaaatttgtttatgtgaaggaagcggcagtttctttcaccttggcaaaagcagcaaccattggagatgtcctgaagctgtttcaatcagcaagagtaaagacggaagatgtgtggtctgcacttactgaaaagtcttttgaattctggaaacttgcgtacagaagagtgcgcaatcttgaagaatttctgaagactcatttttgtaaagctcaaatgtcaattgtgatcctagcagcagtgcttggtgagggcatttggcatctttgttcacaagtcatctataaattgggtggtttgttttctaaagttgttgacttttgtgcaatacactggaaaggtttttgtgaacaattgaagaaggctaagcttcttgtcactgagcacctatgtgtcctgaaaggtgttgcacagcattgttttcaacttttgctggatgcaatacattctatgtacaagagttttaaaaagtgtgtacttggtagaatccatggagacttactcttttggaaaggaggtgtgcataaaattgtccaagaaggcgatgaagtttggttcgacaccatagatagtgttgatgttgaagatctgggtcgtgtccaggaaaaacctgtagattttgaggtttgtgatggtataacacttccagaaaatcaacctggtcatatggtccagtttgaagatgatggaaagaactatatgttcttccgcttcaaacgtgaggacagtgtttattacgcaccaatgtcacaacttggtgcaattaatgttgtttgcaaagcaggtggtaagactgtcacgtttggtgaaactacagtgcgagaaataccatcacctgatgtggtgcctattaaggttagcattgagtgttgtggtgaaccttggaacactatctttaagaaggcttataaagagcccattgaagttgaaacagacctcacagtagaacaattgctcgctgtgatctacgagaaaatgtgtgacgacctcaaattgttcccagaggctccagaacctccaccatttgagaatgtagcacttgttgataagaatggtaaagatttggattgcataaaatcatgctaccttatctaccgtgattatgagagtgatgatgacatcgaagaggatgacgctgaggagtgtgacacagcttcagataatgctgaggaatgtgaaacaacttcggagtgtgaagaagaggatgaaggtacaaaggtgttggctctcatacaagacccagcaagccaaaaataccctctgcctcttgatgatgattacagtgtctatagtggatgtatagtccataaagacgctctcgatgttgtgaatttaccatctggtgacgaaacttttgttatcaacaattgttttgatggcgctgtaaaagaactcccaaagtcagttgtagatgttctaagtgactggggtgcagccgtcgatgcacaggagaagtccttgaatgacgtagctgattccagtagtgtaccagtgccggaggaagatccggtagttagtactaatgtaattcatgaacaggaggtcattcctgttgtagaagaagagcaaagtgtcgttgtcttcacacctgctgaagtcgatgttataaaagaaacaccagatgaatttattctcattccggaagtttctgttgttgaagaagcaattcctgttagcagagaagatgaagtaacttcgcaacaggatgaatttaaagatttttctcgagttgaagatgcaagtggtgcacaacaggaagaatctaaaattgaagagcctcctcaagctgtaaaaacacaacgtgagaagagggctaagaagtttaaagtcaaagtaaccacacaaaaagctcctagttgtttggagtataaaacttgtgtgggtgatttaactgttgtgatagccaaggcattggatgagtttaaagagttctgtgttgtaaacgccgcaaatgagcatatgtctcatgggggtggcgttgcaaaagcaattgcagacttttgtggtccagattttgtggagtattgtgaagactatgttaagaaacatgggccacaacagagacttgtcacaccttcttatgttaaaggcattcaatgtgtgaacaatgttgtaggtccacgccatggggacagtgacttgtttcaaaaactggttactgcgtacaagaatgttattgttgatggcgtggtcaattatgttgtaccagttctctcatctggaatttttggagttgattttaaattgtcaatagatgctatgcgtgcggcctttgatggttgcaacatacgtgtccttctcttttctctgaatcaagaacacatcgaatatttcgatgcaacttgtaagcagaagacaatttatcttacagaagatggtgttaaataccgctctgtagttgtgaaacctggagactctttgggtcagtttggacaggtttttacaagacacaagactgtctttacggctgatgatgttgaagataaagaaattctctttgttccaactactgacaaggctgttcttgattattatggtttggatgcgaaaaagtatgtgatatatttacatacgctttcacaaaagtggaaaatcctagttaaggataattttattcaacttgagtggcgtgatggaaattgctgggttaattcagcaatagtaatccttcaggctgctaagattaagtttacaggttttcttgcaggagcatgggctgctctgttgggtggagatcccacagactttgtagcatggtgttatgcaagttgcaatgctaatgttggtgaattttcagacgctaattggctcttggccaatttggcagaacattttgatgtagattacacgaatgcacttcttaagaagtgtgtttcttgtaattgtggtgttaagagttatgagtttagaggccttgaagcttgcattcagccagtaaaggcacctaatctactacattttaaaacgcaatattcaaattgccccacttgtgattcaaatagtgtagatgaagttgtagaagcttctctcccatatttgcttcttctagcgacggatgggcctgctgcagtagattgtgatgatagtgctgcaggaaacatagtgttcataggttccactaacagtggtcattgttatacacaagccgttggtaaggcttttgataatcttgctagtgatagaaaatttggaaagaagtcgccttacattacagcaatgtatatccgcttctctcttaaaagtgaaaattctatgcctgttgctaacaagagcaaaggtaaaggtcaagtagtaaaagaagatgttgctaactttgctattagttcaaaagtcagttttgataatcttactgactttgagcagtggtatggtagtaacatttatgagagtcttaaagtgcaggaaacatctgacaatcttgatgattatgtgtcatttacaacaaaggaagattccacgttgccactgacacttaaagttcgtggtattaaatcagttgttgattttaagtcaaaggatggctttacttataaattaacacctgatattgatgaaaattcaaaggcacctgtttactacccagtcttagactctgttagtcttagagcaatttgggtagaaggtaatgctaattttgttgttggacatccaaattataatagtagagccttgcgaattcccactttgtgggattgtgcagagagttttgttaaaattggtgaaaaggttaatggtgttactatgggcctatggcgtgcagaacaccttaataaacccaatttggagacgcttttcaatatcgttaagaaaacgattgttggaactaatattgttactacccagtgtggtaaaataatttctaaggctacatcatttatagctgataaagtaggagatggtgtagttcgcaatgttactgatagaattaaagggtgttttgggtttactagggagcattttgaaagaagagtgtctccacagttcttaaaaaccctctttttcttcttcttctgtcttctgaaggctagtgctaagagtttaatgtctagctacaagagtgtgctacgtaaagtggtatttactgctttacttataatatggtttgtctacacaagcaacccagtaatgtttactgggatacgtgtgttagatttcctatttgaaggttcattctgtagtccttatgcagattacggcaaagaatcttttgatgttttacgctattgcggaagtgatttcacttgccgtgtttgtttacatggtagggattcgctacatttgtataaacatgcctatagcgtagaacagttttataaagatgcagttaatggcatcagttttacatggaattggctttatatgctgttcctaatactctttgttaagccagtggcaggttttgttattatttgctactgtataagatatttggttttaagcacaactgtattgcaaactggtgtaggatttttagactggtttattcaaacagtgtttgctaactttaattttatgggggcagggttttatttctggctcttttataagatatatatacaggtgcatcatataatgtactgtaaggatataacatgtgaagtttgtaagagagttgcgcgcagtaatagacatgaggttagtgtagttgttaatgggcgtaaacagcttgtccacgtctacactaactcaggttacagtttctgtaagagacataattggtactgtaagaattgtgacaagtatggtcatcaaaacacatttatgtctcctgaagttgctggtgagctttcagaaaagcttaaacgtcatgttaaacctacagcacatgcataccacgtagtggatgatgcatgcttagttgatgactttgttaatctgaagtacaatgctgccaccccaggtaaagaaggtgtgcattctgctgttaaatgttttagtgtatctgatttcttaaagaaagcagtctttcttaaggatgcacaaaaatgtgaacaaatatctaatgatagttttatagtttgtaatacacacagtgcgcatgcattagaggaagctaaaaatgcagccatctattatgcgcaatgtctttgtaaaccaattcttatacttgatcaggctctttatgaacaattgattgtagaacctgtgtctaagagtgttgtagacaaagtgtgtaatgttttgtctaatataatatctgtagattctgcagctttgaattataaggctggcacacttcgtgatgccctcctttctgttactaaggatgaagaagctgttgatatggctatcttctgccataacaatgatgttgaatatactaatgatggttttactaatgtggtgccatcatatggtatagacactgataagttaacacctcgtgatagaggctttttgataaatgcagatgctgccattgctaacttgaaagtgaaaaattcaccgccagtagtgtggaagtattctgaccttattaaactgtctgacagttgtcttaagtatttaatatcggcaactgtaaagtcaggaggtaggtttttcataacgaggtctggtgctaaacaagttattgcttgttatactcagaagttgttagtggaaaagaaggctggtggtgttgttagtaacactgttagttggtttaggagttgttgtaaatggctcttagtgttctatttactttttacagtgtgttgtttgggttactatcaatgggaaatgagtagagaatttcctcatcccatgtatgattttaattccacaatgcatgtagaagggtttaaggttatagataagggtgtacttagggatattatgccagaagacacttgcttctctaataagtatgttaattttgactcattttggggaaaaccttatgtaaatagtagagactgtcctattgtaaccgctattatagatggtgctggaacagtagctgctggttctcctggttttgtacagtgggtcatggatggtgtaatgtttatccatatgacacaaactgagcgaagaccttggtatattcctacttggtttaatagagaaattgttggttacactcatgattctattgttacagaaggtgagttttatacttccatagcattgtttgcttctagatgtttgtatttaacatctagtaacacaccacagctttattgctttaatggtgatagcgatgctcctggtgcattaccgtttgcaaatatactccctcatagggtatattttcaacctaatggagttaggcttattgtgcctcagcaaattatgcatacaccatacatagttagacttgtttcagatagctattgtagaggtagtgtttgtgaatatactaaaccgggttattgtgtttcaatgaattcccaatgggttttgtttaatgatgaatacacaagtaaaccaggtgtgttttgtggcgctactgttagagaacttttgtttagtatggttagtacattctttactggtgttaatccaaatatttatatgcaattggcaactatgttcttaatacttgttgctgttgttttagtttttgcaatggttataaagtttcaaggtgtttttaaagcttatgcaaccactgtatttactataatgcttgtttgggttattaatgcatttgtgttatgtgtgcatagttataataatgttttagctattatactacttgtgctttattgttatttatcacttgtgacgagtcgtaacactgctataataatgcactgttggcttgtcttcacatttggtttaatagtacctagttggatagcttgtgtctacttaggttttgtattatatatgtatacaccgctggttttgtggtgttatggtacaactaagaattgccgtaagctttatgaaggcaatgagtttgttggtaattatgacctcgctgcgaagagtacttttgtaattcgtggccctgaatttgttaaacttactaatgagataggcgataaatttgacgcctacctctcagcgtatgctagacttaaatactattcaggtactggcagtgagcaagattacttgcaagcctgccgtgcatggttggcttatgcactagatcaatttagaagcagtggtgtagaagtagtgtataccccaccacggtattctattggtgttagtagattacaggctggttttaagaaactagcagctcctagtagcgctgttgagaagtgcattgttagtgtgtcctataggggtaataatcttaatggattgtggttgggtgattctatttactgtccacgtcatgtgttaggtaagtttagtggtgatcaatgggatgacgtacttaatcttgctaataatcatgagtttgaagttgtaactggaaatggtgttactttggctgttgtcagtaggcgtttgagaggtgcagttttgattttacaaactgcaattgctaatgctgaaactccaaagtataaattcatgaaagcaaattgtggtgacagttttaccattgcttgctcttatggtggtacggttataggactttaccctgtcactatgcgttctaatgggactattagagcgtcttttcttgccggagcatgtggttcagtaggttttaatatagaaaggggtgtagtaaatttttactatatgcaccatctagaattgcctaatgcattacacactggaactgatctaaatggtgcgttctatggtggttgtgttgatgaggaggttgcacagagagtgccaccagataaccttgttactaacaacattgttgcatggctttatgctgcaattattagtgttaaagagagtagtttttcaacgcctaaatggcttgaaagtactactgtcagcgttgatgattataataagtgggctggtgataatggttttacaccgttttcaactagcactgctatcactaaattaagtgctataacgggagttgatgtttgtaaactccttcgcactattatggttaagtctagtcaatggggcaatgaacccattttaggccaatataattttgaggatgaactaacaccagaatctgtttttaaccaggttggtggtgtcagactacagtcttcttttgtgaaaagagctacatcttggttttggagtagatgtgtgttagcttgtttcttatttgttttgtgtgctattgttttgtttacggcagtgccacttaaatattatgtgcatgcagctgttgttttgttagcggctgttacatttatctcttttactgttaaacatgttatggcatatatggatactttccttttgccgacattgattacagttattattggagtttgtgctgaagtacccttcatttacaatactctaattagtcaaattgttattttctttagccaatggtatgatccagtagtgtttgatactatggtaccatggatgttcttaccattagtgctgtacacagcttttaagtgtgtacaaggttgctatagtgtaaattctttcaatacttctctgttagttttgtaccagtttatgaagttggggtttgttatctatacctcttctaacactgttactgcatactcggaaggtaattgggagctattctttgaattagtacacactactgtgttggctaatattagtagcaattccttaattggtttatttgtatttaagttggctaaatggatgctgtattattgtaatgcaacatactttaataattatgtgctaatggcagtcatggttaatggcttaggttggctctttacttgttactttgggttttattggtgggttaataaggtttttggtttaaccttaggcaaatataatttcaaagttccggttgatcaatataggtatatgtgtcttcataagataaaaccacctaaaactgtgtgggaagtcttttcgacaaatatacttatacaaggtataggtggtgagcgtgtgcttcctatagccacagttcaatctaaattaagtgatgtaaaatgcacaacagttgtcttaatgcagcttttgactaagcttaatgttgaagcaaattcaaaaatgcatgcttatcttgtagagttgcacaataaaattcttgcctctgatgatgttaatgagtgcatggataatttgttgggtatgcttgtaacactattttgtgtagatagtactattgatttaagtgagtattgtgatgatatacttaagagattaactgttttacagtcagttactcaggagttttcacacataccttcttatgcagaatatgaaagagctaaaaacctctatgaaagggtgttagctgattctaaaaatggtggtgttacacagcaagaacttgctgcatatcgtaaggctgccaatattgcaaagtcggtctttgatagagacttggctgtacaaaagaagttagatagcatggcagagcgcgctatgacaacgatgtataaggaagcgcgtgttactgatagaagagcgaaacttgtttcttcattacatgcgctgttattttctatgcttaagaagatagattctgaaaagcttaatgtactattcgaccaggcaagcagtggtgttgtgccactagctactgttcctatagtttgtagtaataagcttactcttgtagtgccagacccagaaacatgggtcaagtgcgtagagggcatgcatgttacatattcaacagttgtttggaatattgataatgttactgacgcagatggcactgaattgcaaccaatttctacaggtaatggtttaacatactgtataagtggtgataatatagcatggccccttaaggtcaatttgactaggaatgtgcataacaaagttgatgcagcattgcagaacaacgagcttatgcctcatggtgtaaaaacaaaggcatgcgtggcaggtgtagatcaagcacactgcagcgtagagtctaaatgttattatactaatattagtggtaattcagtagtggctgctattacctcctcaaatcctaatttgaaagtcgcctcatttttgaatgaagcaggcaaccaaatctacgttgacttagacccaccatgtaaatttggtatgaaggtgggtgataaagtagaagttgtttacttgtattttataaagaatacaaggtcaattgttaggggtatggtacttggtgctatatctaatgttgtagtgttacagtctaaaggacatgagacagaggaagtggatgctgttggcatattatcactttgttctttttcagtggatccagctgacacgtattgtaagtatgtagcagcaggtaaccaacctttaggtaactgtgttaaaatgttgacagttcataatggtagtggctttgctataacatcaaagccaagtccaactcctgatcaggattcttatggaggagcttccgtgtgtctctattgtagagcacatatagctcacccaggaagtgcaggaaatttagatggacgttgtcaatttaaaggttcttttgttcaaatacctactacggaaaaagaccctgtagggttctgtctacgtaacaaggtttgcactgtttgtcagtgttggataggtcatggatgtcaatgtgattcacttagacaaccaaaacctttggttcaatcagatgctggtgcatctggttttgataagaattatttaaacgggtacggggtagcagtgaggctcggctgataccccttgctaatggatgtgatcctgatgttgtaaagcgagcctttgatgtatgtaacaaggaatcagccggtatgtttctaaatttgaagcgtaattgtgcgcgattccaagaggttcgcgatactgaaggtggaaatcttgagtattgcgattcttattttgtggttaaacagaccactcctagtaattatgaacatgagaagtcttgttacgaagacttaaagtcagaagtaacggctgatcatgatttctttgtgttcaataagaacatttataatattagtaggcaacgacttactaagtatactatgatggacttttgttatgctttgaggcattttgacccaaaggattgcgaagtttttaaagaaatacttgtcacttatggttgtatagaagattatcaccctaagtggtttgaggaaaataaggattggtacgacccaatagaaaacccaaaatattatgctatgttggctaaaatgggccctattgttcgtcgagcactattaaatgctgttgagtttggaaacctaatggttgaaaagggttatgttggtgtggttacactagataaccaagacctcaatggcaaattttatgattttggtgattttcaaaaaacagcacctggtgctggtgttcctgtttttgatacatattattcttacatgatgcccatcatagccattacggatgctttagcacctgaacggtattttgaatatgatgtgcataagggttataagtcttatgatctcctcaagtatgattatacagaggagaaacaagaattgtttcagaagtactttaagtactgggatcaagagtaccaccctaattgttgtgattgtgcagacgataggtgtttgatacattgtgcaaacttcaatgtacttttctctacactgataccacagacttcttttggtaatttgtgtagaaaggtctttgttgatggtgtcccttttatagctacttgtggctatcattctaaggaacttggtgttattatgaatcaagataacaccatgtcattctcaaaaatgggcttaagccagcttatgaaatttgtaggagatcctgcccttttggtaggaacttctaacaatttggttgatcttagaacttcttgctttagtgtctgtgcattagcttctggtataacacaccagacagttaagccaggtcactttaataaagatttctatgattttgctgaaaaagcaggtatgtttaaggaagggtcatcaatcccacttaaacacttcttctatccacagactggtaatgctgctataaacgattatgattattatcgttataacaggcctactatgtttgatatacgccagcttctattctgtttagaggtgacgtctaaatattttgactgttatgaaggtggttgtataccagctagtcaagtggttgttactaaccttgataagagtgcaggctttccatttaataaatttggaaaagctcgtctttattatgaaatgagtctagaagagcaggaccaactctttgaaagtacaaagaaaaatgtcctacccactataactcagatgaatcttaaatatgccatatccgcgaaaaatagagcgcgtactgtggcaggtgtgtcaattctttctactatgactaatagacaatttcaccagaaggtgcttaagtctatagtcaatactagaaatgcttctgtagtaataggaacaaccaaattttatggtggttgggataatatgttaagaaaccttattcaaggtgtggaagacccaatgcttatgggttgggattatcctaagtgtgatagagcaatgccaaatttgttgcgtatagcagcgtctttggtgcttgcccgtaaacacaataattgttgcacatggtctgagcgcatttatagattgtacaatgagtgcgcccaagtattgtctgaaactgtattagctacaggtggtatttatgtaaagcctggtggtactagcagcggagatgctaccactgcttatgccaacagtgtttttaatataatacaagccacatctgctaatgttgcgcgtttgcttagtgttataacgcgtgatatagtatatgatgacattagaagcctgcagtatgaattataccagcaggtttatagacgagtcaattttgatgcagcctttgtcgaaaagttttattcttacatgtgtaagaatttttcattaatgatcttgtctgatgatggtgttgtttgttataacaacacacttgccaaacaaggtcttgtagcagatatttctggttttagagaaattctctactaccaaaataatgtttatatggcagattctaagtgctgggtggaaccagatttagaaaaaggcccacatgaattttgttcacagcacacaatgctagtagaggttgacggagagctaagatatttgccatatccagacccctcacgcatttttggtgcatgtgtttttgtagatgacgtggataaggctgggcctgtggctgttatggagcgttatatagctctcgccatagatgcttacccgcttgtacatcatgaaaatgaggagtataagaaagtcttctttgtactcctttcttatattagaaaactctatcaggagctctcccaaagtatgcttattgactactcctttgttatggatgtagacaagggtagtaagttttgggaacaggagttctatgagaatatgtacagagccccaacaaccttacaatcttgtggtgtttgtgtagtttgtaatagtcaaactatactacgctgtggtaattgtattagaaaaccattcttgtgttgtaaatgttgttatgaccatgtcatgtatactgaccacaaaaatgttttgtctataaacccatacatttgctctcaacctggttgtggtgaagcagatgttactaaactttacctcggaggtatgtcctacttctgtggtaatcataaacctaaattatcaataccgttagtatctaatggtactgtttttggaatttatagggccaattgtgtaggtagtgaaaatgttgatgattttaatcaactagctactactaattggtctaccgttgaaccttatatattagcaaatcgctgtagcgactcattaagacgctttgctgctgagactgtcaaagcaacagaagagttgcataaacagcaatttgctagtgcagaagtcagagaggttatttctgaccgtgaattaattctatcgtgggaacctggtaagactagacctcccttgaatagaaattatgttttcactggctatcactttaccaggacaagtaaggtacagctaggtgattttacttttgagaaaggtgaaggtagagatgttgtctattatagggcgacgtctacagctaaattgtctcctggagatatctttgtcttaacatcacacaatgttgtttctcttgtagcaccaactttgtgtcctcaacaaaccttttccaggtttgttaatttaagacctaatgtaatggtaccggagtgttttgttaataacattccattataccatttagtaggtaaacaaaagcgtactacagtacaaggccctcctggcagtggtaagtcacactttgccataggccttgctgcatactttagtaatgctcgtgttgtttttacagcatgttctcatgctgcagtagatgcgctttgtgaaaaagcgtttaaatttcttaaagttgatgattgcactcgcatagtacctcaaaggactactgttgactgcttctcaaaatttaaagctaatgacacaggcaaaaagtacatttttagtactattaatgccttgccagaagttagttgtgacattctgttggtagatgaggttagtatgttgaccaattatgaattgtcatttattaatggtaagataaattaccagtatgttgtgtatgtaggtgatcctgcccaattaccggcacctcgtactttgcttaatggttcactttcacctaaggattataatgtcatcacaaatcttatggtttgtgttaaacctgacattttccttgcgaagtgttatcgttgtcctaaagaaattgtagacactgtttctactcttgtctatgatggaaagtttgttgcaaataacccagagtcacgtgagtgtttcaaggttgtagttaataatggtaattctgatgtaggtcatgaaagtggttcagcctacaacacaacacagttggaatttgtgaaagattttgtttgtcgcaataaacaatggcgagaagcaacatttatttcaccttataacgccatgaatcagagagcctaccgcatgttgggacttaatgtccagactgtagactcatcacagggttcagagtatgattatgttatattctgtgtcactgctgattctcagcatgcgctgaatattaacagatttaatgttgcgcttacaagagctaagcgtggtatacttgttgtcatgcgtcagcgtgacgaattgtatgccgctcttaaatttacagagcttgatgctggggcaagcctgcaaggtacaggtttgtttaaaatttgcaataaggagtttagtggagtacatcctgcttatgctgtaaccactaaagcgcttgcggcaacgtacaaagttaatgacgaactagcagcacttgttaatgtagaagctggttcagaaataacttataagcatcttatttctctgttagggtttaagatgagtgttaatgttgaaggttgtcataacatgtttataacacgtgacgaggcaatccgcaatgtaagagggtgggtaggttttgatgtagaagccactcatgcttgtggtactaacattggaaccaaccttccatttcaagtaggattctctactggtgctgactttgtagtcacacctgagggtcttattgatacctcaataggcaataattttgagcctgtaaactctaaagcacccccaggtgaacaatttaatcacttgagagctttgtttaagagtgctaagccttggcatgttataagaccaaggatagttcagatgttagcagacaatctatgcaatgtttcagattgtgtagtgtttgtcacatggtgtcatggcctagaactaactactttgcgctattttgttaaaataggcaaggaacaagtttgttcttgtggttctagagctacaacttttaattctcacactcaggcttacgcttgttggaggcactgcttgggtgtctataatccacttttagtggatattcaacaatggggttactctggtaatctacagtttaatcatgatttgcattgtaatgtgcatggccacgctcatgtagcttcagctgatgctgtaatgacccgctgccttgcaattaataatgcattctgtaaagatgtcaactgggaactgcagtaccctcatattgcaaatgaggatgaagtaaattccagttgcaggtatctacaacgcatgtatcttaatgcgtgtgttgatgctcttaaagtcaatgttgtctatgatataggcaaccctaaaggtataaaatgtgttagacgtggggatgtcaattttaggttctatgataagaacccaattgtacctaacgtcaaacagtttgagtatgactatagtcagcataaagataagtttgctgatggtctttgtatgttttggaattgtaatgtggattgttatcctgaaaattcattagtttgtaggtatgacacacgaaatttgagtgtgtttaacctaccaggctgtaatggtggtagcctgtatgttaataaacatgcattccacacacctaagtttgatcgcattagctttcgtaatttgaaagctatgccatttttcttctatgattcatcgccttgcgaaaccattcaggttgatggagtagcgcaggaccttgtttcattagcaactaaagattgtatcacaaaatgcaacattggtggtgctgtttgtaagaaacacgctcaaatgtatgcagaatttgtgttttcatataatgcagctgtcacagctggttttactttttgggttactaataattttaacccttataatttatggaaaaatttttcagctctccagtctattgacaatattgcttttaatatgtataagggtgggcattacgatgctattgcaggcgaaatacccacagtcataactggagataaagtttttgttattgatcaaggtattgaaaaggcagtttttgttaatcaaacaactctgcctacatcagttgcatttgagttgtatgcgaaaagaaacattcgcacactgccaaacaacagaatattgagtggtttaggtgtagacgtgacccacggttttgtaatttgggattacgctaaccaaacaccattatatcgtaatactgttaaagtttgtgcatacacagacattgagcccaatggcttaatagttctgcatgatgatagatgtggtgattaccaatcttttcttgccgctgataatgctgttttagtgtctacacagtgttataagcggcatccttatgtagaaataccatcaaatctgcttattcagaatggtatgcctctaaaagatggagcgaacctgtatgtttataagaggagtaatggagcgtttgtgacgctaccaattacacttaacacacagggtcgtaattatgaaacttttgaacctcgtagtgatgttgagagagatttccttgacatgtctgaggatgattttgttgaaaagtatggtaatgacttaggtctacaacacatactttatggtgaagttgaaaaaccacaattgggtggtttacacactgttattggtatgtacaggctattgcgtgaaaataagttaagcgcaaaatctgtcactaactcagattcagatgtcatgcaaaattattttgtactgacagataatggttcttacaagcaagtttgtactgttgtagacctattgctagatgatttcttagaacttcttaggaacatacttaaagagtatggtactaataagtccaaagttgtaacagtgtctattgattaccatagcataaattttatgacttggtttgataatggcagtattaaaacatgttatccacagcttcaatcagcgtggacgtgtggttataatatgcctgaactctacaaggttcagaattgtgttatggaaccttgcaatattccaaactatggtgttggaattacattgccaagtggtattatgatgaatgtggcaaagtatacacaactttgtcagtatctttctaagactacaatgtgtgtgccgcataatatgcgtgtaatgcactttggagctggtagtgataaaggagtagcaccaggcagcactgttcttaagcagtggctgcctgagggaacactccttgttgataatgatattgtagattatgtatctgatgcacatgtttctgtgctttcagattgcaataaatataaaacagtgcacaagtttgaccttgtgatatctgatatgtatacagataatgattctaagggaaaacatgaaggcatagtagccaataatggcaatgacgatgtcttcatttatctatctaattttttaaagaacaacttagctcttggtggtagttttgccattaaagttacagagacaagttggcatgagagtttatatgacatcgcacaagattgtgcatggtggacaatgttttgtacagcagtaaatgcttcttcttctgaagcatttttactgggtattaattatttgggtgcaagtggaaaagtgaaagtaagtggaaaaactctgcacgcaaattatatattttggcggaattgtaattatttacaaacctctgcttatagtatatttgacgttgctaagtttggattaaaactaaaagcaacgccagttgtaaatttgaaaactgaacaaaagaccgacttagttgttaatctactaaggaacggcaagttattgattagagatgttggggaagtcactgtttttagtgaccattttgtgtgcactatgtagtgcaaatttgttcgatcctgccaattatgtgtactactaccaaagtgcctttaggccttcaaatgggtggcatttgcaagggggtgcttatgcagtagtgaattcttctaattatgctaataatgcaggttctgcatctgagtgcactgttggtgttattaaggatgtctataatcaaagtgcggcttccatagctatgacagcacctcttcagggtatggcttggtctaagtcacaattttgtagtgcacactgtgacttttctgaaattacagtttttgtcacacattgttatagtagtggatcagggtcttgtcctataacaggcatgattgcacgtggtcatattcgtatttctgcaatgaaaaatggttctttattttataatttaacagttagcgtatctaaataccctaattttaaatcttttcaatgtgttaacaacttcacatctgtttatttaaatggtgatcttgtttttacttccaacaaaactactgatgttacgtcagcaggtgtctattttaaagcaggtggacctgtaaattatagtattatgaaagaatttaaggttcttgcttactttgttaatggtacagcacaagatgtaattttgtgtgataactcccccaagggtttgctagcttgtcaatataacactggcaatttttcagatggcttttatccttttactaatagtactttagttagggaaaagttcattgtctatcgtgaaagtagtgttaatactactttggcgttaactaatttcacttttactaatgtaagtaatgcacagcctaatagtggcggtgttcatacttttcatttatatcaaacacaaacagctcagagtggttattataattttaatttgtcatttctgagtcagtttgtgtataaggcaagtgattatatgtatgggtcttaccaccctatttgtgcttttagaccagaaaccattaatagtggtttgtggtttaattccttgtcagtttctcttacttatggacccctacagggagggtataagcaatctgtttttagtggtaaggcaacgtgttgttatgcctactcttataatggcccaagggcatgtaaaggtgtttattcaggtgaattaagcagggattttgaatgtggattgctggtttatgttactaagagtgatggctctcgtatacagactagaacggagcccttagtattaacgcaacacaattataataatattactttagataagtgtgttgcctataatatatatggcagagtaggccaaggttttattactaatgtgactgattctgttgctaattttagttatttagcagatggtgggttagctattttagatacgtcgggtgccatagatgtttttgttgtacagggcagctatggtcttaattattacaaggttaatccttgtgaagatgttaaccaacagtttgtagtgtctggtggcaatatagttggcattcttacttctagaaatgaaacaggttctgaacaggttgagaaccagttttatgttaagttaaccaatagctcacatcgtcgcaggcgttctattggccaaaatgtaacaagttgtccttatgttagttatggcaggttttgtattgaaccagatggttcgttgaagatgatagtgccagaagaattgaagcagtttgtggcacctttacttaatattactgaaagtgtactcatacctaacagttttaatttgactgttacagatgagtacatacaaacacgtatggataaggtccaaatcaattgccttcaatatgtctgcggcaattctttggagtgtagaaaattgtttcaacaatatggtccggtttgtgataatatattgtctgttgtaaatagtgttagtcaaaaagaagatatggaacttttgagcttctattcttctactaaaccaaagggttatgatacaccagttcttagtaatgtaagcactggtgagttcaatatttctcttctcttgacaccccctagtagtcctagtgggcgttctttcgttgaagatcttctgtttacaagtgttgaaacagttggtttaccgactgatgctgaatacaaaaaatgcacagcgggacctttgggtacccttaaagatcttatctgtgctagggaatataatggtttattagtgttgcctccaatcattacggcggatatgcaaacaatgtataccgcgtctctagtaggtgctatggcttttggtggtattacatcagctgcagctataccttttgctactcagattcaggcaagaattaatcatcttggtattgcacagtctttgttaatgaaaaaccaagaaaagattgctgcttcctttaataaggccattggtcatatgcaggaaggttttagaagcacttcgctagcattacaacaggttcaagatgttgttaataagcagagtgctattcttacggaaactatgaattctcttaataagaattttggtgctatttcatcagtcattcaagacatttacgcgcaacttgatgcaattcaagcagatgcacaagttgatcgtcttataactggtaggctttcatcactctcagtgctagcttcagctaagcaatctgagtacattagagtttcccaacagcgtgaattagccactcaaaaaattaatgagtgtgttaaatcacaatctaatagatatggattttgtggtagtggaagacatgttctttcgatacctcaaaatgcacctaatggcatagtgtttattcactttacttatactccagaaacgtttgttaatgtgacagcaatagtcggtttctgtgtaaacccacttaatgctagtcagtatgccatagtacctgctaacggaaggggcatttttatacaagttaatggtacatactatatcacatctcgtgatatgtatatgccaagagacattactgcaggagatatagttacgcttacgtcttgtcaagcaaactatgttaatgtaaataaaaccgtcattactacatttgtagaagatgacgattttaattttgatgatgagttgtctaaatggtggaatgacactaagcacgggctaccagactttgacgacttcaattacacagtacccatacttaatattagcggtgaaattgataacattcaaggtgttatacagggtcttaatgactcccttataaaccttgaagaactttcaataattaaaacttatattaagtggccttggtatgtttggcttgccataggctttgctattattatttttatccttattttaggatgggtgtttttcatgacaggttgttgtggttgttgttgtggatgctttggtatcattcctctaattagtaagtgtggtaagaaatcttcttattacactacttttgataatgatgtggtaactgaacaatacagacctaaaaagtctgtttaatggttcaaactcccgcatcttttgtaatactatcaatttttctttggtttaaacttgcattaagttgtttcagtgagtgcattgtagcacttcaacagctaatacaagttttactccaaattattaataataatttacaatctaggctgctcctttggcacagcctagactaatgttagattttgagaaaataattggaacaggtgaacagtcagtacaacaaatcagtttcaatttacaatatatttcaagtgtcctaaaaactcaaatttttgacccatttgagtattgttattattcaagtggtagtttttatgaaatagagtcagctgacgattgttcagatgccgaatttattgaataaatcgctagaagagaacggtagttttctaacagccctttatatatttgtggtatttgtagcactttacctattaggtagagcactacaagcttttgtacaagcagctgatgcttgttgtttattttggtacacatgggtagtagttccaggagttaagggtacagcctttgtatacaagcatgcatatggtagaaaacttaacaatccggagttagaacacgttattgttaacgagtttcctaagaacggttggaataataaaagtctaccaaattttcaagatgtccaacgtgacaaattgcacccttgattctgatcaggctattctgctcttcaaggaatataatctatttataaccgcattcctattgtttataaccatactacttcagtatggatacgcaactaggagtcgggttatttacatactgaaaatgttagtgttatggtgcttttggcccattaacattgcagtaggtgtaatttcatgtatatatccaccaaatacaggaggtcttgtcgcagcgatagtacttactgtgtttgcgtgtttctcttttataggttattggattcagagcattagactctttaagcggtgtagatcttggtgggcatttaacccagaatcgaatgccgtaggttcaatactcctaactaatggtcaacaatgtaattttgctatagagagtgtgccaatggtgctttctcctattataaagaatggtgctctttattgtgagggtcagtggcttgccaagtgtgaaccagaccacttgcctaaggacatatttgtttgtactccggatagacgtaacatctatcgtatggtacagaaatacactggtgaccaaagcggaaataagaaaaggtttgctacatttgtctatactaaacagtcagtagatactggcgagcttgaaagtgtagcaacaggaggaagtagtctttacacataaatgtgtgtgtgtagagagtatttaaaattactctttaatagtgcctctattctaagagcgcataagagtatatattttgaggatcttaatataaatcccctttgtttcatactctcttttcaagagttattatttaaagagcagtttttccactcttttgtgccaaaaactattgttgttaacggtgtagcctttcaagtagagaatggaaaagtctactacgaaggaacacccatttttcagaaaggttgttgtaggttgtggtcccactataagagggattagaatacttaaaccacctacaacaattgtatttaaaaaaggtgtttgggtttacaaacgcttaagagaaacaaatacggaatgaaatggttgtctagtttaggaagagcattcattttctgttataaatccctattactaactcaacttagagttttagataggttagttttagagcacggtactagacgcagctttatatgtgctaggcgagtgcttttagttcaattagatttagtttataggttggcatatactcccaaccaatcgctggtatgaataatagtaaagataatccttttcgcggagcaatagcacgaaaagcgcgaatttatctgagaggaggattagattgtgtttactttcttaacaaagcaggacaagcagagccttgccccgcgtgcacatcactagtattccaggggaaaacttgtgaagagcacatacgtaataataacttgctatcatggcgagcggtaaagcagctggaaagtcagactcccccgcgccaatcatcaaactaggaggaccaaaaccaccaaaggtagggtcatctggaaatgcatcttggtttcaagccataaaggccaagaaactaaatgcacctgcacctaagtttgaaggtagtggtgttcctgataatgaaaatcttaaaaatagccagcagcacgggtactggaggcgccaagccaggtttaagccaggtaaaggcggaagaaaaccagtccctgatgcgtggtatttctattacactggaacaggaccagccgctgacctgaattggggtgattctcaagatggtatagtgtgggttgctgctaagggtgctgatgtgaaatctagatccaaccagggtactagagatcctgataagtttgatcaatacccactacggttttcagatggaggacctgatggtaatttccgttgggacttcattcctctgagtcgtggtaggagtggaagatcaaccgcagcatcatcagcggcatctagtagagtaccatcccgtgagggttcacgtggtcgtaggagtggagctgaagatgatctgattgcccgtgcagcaaagattattcaggaccagcagaggaagggtacgcgcattactaagcaaaaggcagaagagatggctcatcgccgattctgtaagcgtacggtgccaccaggttatagagtagatcaagtttttggccctcgtactaaaggtaaagagggtaattttggtgatgacaagatgaatgaggaaggtattaaggatgggcgtgttacagcaatgctcaaccttacaccaagcccacatgcttgtctttttggaagtagagtgacgcccaagcttcaaccagatgggcttcaccttagatttgaatttactactgtggtgcctagagatgacccgcagtttgataattatgtaaaaatttgtgatgagtgtgttgatggtgtaggaacacgtccaaaggacgaagttgtaagaccaaagtcacgcccaaattcaagacctgctacaagaacaagttctccagcgccaagacaacagcgtcaaaagaaggagaagaagtcaaagaagcaggatgatgaagtagataaggcattgacctcagatgaggagaggaacaatgcacagctggaatttgatgatgaacccaaggtgattaactggggggattcagcacttggagagaatgagttgtaaagctagatttccaacttaacatcatggacgtgcgtatgctgtttttccctactatagactttttagcatattattttttgctatttgtatggtttattacaggtgaagattgtatgtatttgttgtatactcgtatgttctatattatgttttctgtagttgttattagtgttgttcttgttcttattctactgttctcttttctttattttagagtatcaataagaatcaaggaagataggcatgtagtttgattacctacatgtctatcgccagggaaatgtctaatctgtctacttagtagcctggaaacgaacggtagacccttagattttaatttagtttaatttttagtttagtttaagttagtttagagtaggtataaagaagccagtgccggggccacgcggagtacgatcgagggtac

SEQ ID NO: 21 - DNA, 31028 bp, Coronavirus
gattgcgagcgatttgcgtgcgtgcatcccgcttcactgatctcttgttagatcttttcataatctaaactttataaaaacatccactccctgtagtctatgcctgtgggcgtagatttttcatagtggtgtctatattcatttctgctgttaacagctttcagccagggacgtgttgtatcctaggcagtggcccacccataggtcacaatgtcgaagatcaacaaatacggtctcgaactacactgggctccagaatttccatggatgtttgaggacgcagaggagaagttggacaaccctagtagttcagaggtggatatagtatgctccaccactgcgcaaaagctggaaacaggcggaatttgtcctgaaaatcatgtgatggtggattgtcgccgacttcttaaacaagaatgttgtgtgcagtctagcctaatacgtgaaattgttatgaatacacgtccatatgatttggaggtgctacttcaagatgctttgcagtcccgcgaagcagttttggttacaccccctctaggtatgtctctggaggcatgctatgtgagaggttgtaatcctaatggatggaccatgggtttgtttcggcgtagaagtgtgtgtaacactggtcgctgcgctgttaacaagcatgtggcctatcagctatatatgattgaccctgcgggtgtctgttttggtgcaggtcaatttgtgggttgggttatacccttagcctttatgcctgtgcaatcccggaaatttattgttccttgggttatgtacttgcgtaagtgtggcgaaaagggtgcctacaacaaagatcataaacgtggcggttttgaacacgtttataattttaaagttgaggatgcttacgacttggttcatgatgagcctaagggtaagttttctaagaaggcttatgctttaattagaggataccgtggtgttaaaccgcttctttatgtagaccagtatggttgtgattatactggtggtcttgcagatggcttagaggcttatgctgataagacattgcaagaaatgaaggcattatttcctatttggagccaggaactcccttttgatgtaactgtggcatggcacgttgtgcgtgatccacgttatgttatgagactgcaaagtgcttctactatacgtagtgttgcatatgttgctaaccctactgaagacttgtgtgatggttctgttgttataaaggaacctgtgcatgtttatgcggatgactctattattttacgtcaacataatttagttgacattatgagttgtttttatatggaggcagatgcagttgtaaatgctttttatggtgttgatttgaaagattgtggttttgttatgcagtttggttatattgactgcgaacaagacttgtgtgattttaaaggttgggttcctggtaatatgatagatggttttgcttgcactacttgtggtcatgtctatgagacaggtgatttgctagcacaatcttcaggtgttctgcctgttaatcctgtattgcatactaagagtgcagcaggttatggtggttttggttgtaaggattcttttaccctgtatggccaaactgtagtttattttggaggttgtgtgtattggagtccagcacgtaatatatggattcctatattaaaatcttctgttaagtcttatgacggtttggtttatactggagttgtaggttgcaaggctattgtaaaggaaacaaatctcatttgcaaagcgttgtaccttgattatgttcaacacaagtgtggcaatttacaccagcgggagttgctaggtgtgtcagatgtgtggcataaacaattgttattaaatagaggtgtgtacaaacctcttttagagaatattgattattttaatatgcggcgcgctaaatttagtttagaaacttttactgtttgtgcagatggttttatgccttttcttttagatgatttggttccgcgcgcatattatttggcagtaagtggtcaagcattttgtgactacgcagataaaatctgccatgctgttgtgtctaagagtaaagagttacttgatgtgtctctggattctttaagtgcagctatacattatttgaattctaaaattgttgatttggctcaacattttagtgattttggaacaagttttgtttctaaaattgttcatttctttaagacttttactactagcactgctcttgcatttgcatgggttttatttcatgttttgcatggtgcttatatagtagtagagagtgatatatattttgttaaaaacattcctcgttatgctagtgctgttgcacaagcatttcggagtgttgctaaagttgtactggactctttaagagttacttttattgatggcctttcttgttttaagattggacgtagaagaatttgtctctcaggcagtaaaatttatgaagttgagcgtggcttgttacattcatctcaattgccattagatgtttatgatttaaccatgcctagtcaagttcagaaagccaagcaaaaacctatttatttaaaaggttctggttctgatttttcattagcagatagtgtggttgaagttgttacaacttcacttacaccatgtggttattctgaaccacctaaagttgcagataaaatttgcattgtggataatgtttatatggccaaggctggtgacaaatattaccctgttgtggttgatggtcatgtaggactcttggatcaagcatggagggttccttgtgctggaaggcgtgttacatttaaggaacagcctacagtaaatgagattgcaagcacacctaagactattaaagttttttatgagcttgacaaagattttaatactattttaaacactgcatgtggagtgtttgaagtagatgataccgtggatatggaggaattttatgctgtggtgattgatgccatagaagagaaactttctccatgtaaggagcttgaaggtgtaggtgctaaagttagtgcctttttacagaaattagaggataattccctatttttatttgatgaggctggcgaggaagttcttgcttctaaattgtattgtgcttttacagctcctgaagatgatgactttcttgaagaaagtggtgttgaagaagatgatgtagaaggtgaggaaactgatttaactgtcacaagtgctggagagccttgtgttgccagtgaacaggaggagtcttctgaaatcttagaggacactttggatgatggtccatgtgtggagacatctgattcacaagttgaagaagatgtagaaatgtcggattttgctgatcttgaatctgtgattcaggattatgaaaatgtttgttttgagttttatactacagagccagaatttgttaaagttttggatctgtatgtgcctaaagcaactcgcaacaattgctggttgcgatcagttttggcagtgatgcagaaactgccctgtcaatttaaagataaaaatttgcaggatctttgggtgttatataagcaacagtatagtcagttgtttgttgataccttggttaataagatacctgctaatattgtagttccacaaggtggttatgttgccgattttgcatattggttcttaaccttatgtgattggcagtgtgttgcatactggaaatgcattaaatgtgatttagctcttaagcttaaaggcttggatgctatgttcttttatggtgatgttgtctcacatgtgtgcaagtgtggtgagtctatggtacttattgatgttgatgtgccatttacagcccactttgctcttaaagataagttgttttgtgcatttattactaagcgtagtgtgtataaagcagcttgtgttgtggatgttaatgatagtcattctatggctgttgttgatggtaaacaaattgatgatcatcgtgtcactagtattactagtgataagtttgattttattattgggcatggtatgtcattttcaatgactactttcgaaattgcccaattgtatggttcttgtataacacctaatgtatgttttgttaaaggtgatataattaaagtttctaagcgtgttaaagcagaagtcgttgtaaatcctgctaatggccatatggcacatggtggtggtgttgcaaaggctattgcagtagcagctggacagcagtttgttaaagagactaccgatatggttaagtctaaaggagtttgtgctactggagactgttatgtctctacagggggtaaattatgtaaaactgtgcttaatgttgttggacctgatgcgagaacacagggtaaacaaagttatgcattgttagagcgtgtttataaacatcttaacaaatatgattgtgttgttacaactttgatatcagctggtatatttagtgtgccgtctgatgtgtctttaacatatctacttggtactgccgagaaacaagttgttcttgttagcaataatcaagaggattttgatcttatttctaagtgtcagataactgccgttgagggcactaagaaattggcagagcgtctttcttttaatgtagggcgttctatcgtttacgaaacagatgctaataagttgattttaagcaatgacgttgcatttgtttcgacatttaatgtcttacaggatgttttatccttaagacatgatatagcacttgatgatgatgcacgaacctttgttcagagcaatgttgatgttgtacctgagggttggcgtgttgtcaataagttttatcaaattaatggtgttagaaccgttaagtattttgagtgtcccggtggcatagatatatgcagccaggataaagtttttggttatgtacagcagggtagttttaataaggctactgttgctcaaattaaagccttgtttttggataaagtggacatcttgctaactgttgatggtgtcaatttcactaacaggtttgtgcctgtaggtgaaagttttggtaagagtctaggaaatgtgttctgtgatggagttaatgtcacgaaacataagtgtgatataaattataaaggtaaagtctttttccagtttgataatctttctagtgaagatttaaaggctgtaagaagttcttttaattttgatcagaaggaattgcttgcctactacaacatgcttgttaattgttctaaatggcaggttgtttttaatggtaagtatttcacttttaagcaagctaataacaattgttttgttaatgtttcttgcttaatgctccagagtttgaatctgaaatttaaaattgttcaatggcaggaggcgtggcttgaatttcgttctggccgccctgctagatttgtatctttggttttagccaaaggtgggtttaaatttggtgatcctgctgactctagagatttcttgcgtgttgtgtttagtcaagttgatttgacaggggcaatatgtgattttgaaattgcatgtaaatgtggtgtaaagcaggaacagcgtactggtgtggacgctgttatgcattttggtacattgagtcgtgaagatcttgagattggttacaccgtggattgttcttgcggtaaaaagctaatccattgtgtacgatttgatgtaccatttttaatttgtagtaatacacctgctagtgtaaaattacctaagggtgtaggaagtgcaaatatttttaaaggtgataaggttggtcattatgttcatgttaagtgtgaacagtcttatcagctttatgatgcttctaatgttaagaaggttacagacgttactggcaatttgtcagattgtttgtatcttaaaaatttgaaacaaacttttaaatcggtgttaaccacctattatttggatgatgttaagaaaattgagtataaccctgacttgtcacaatattattgtgacggaggtaagtattatactcagcgtattattaaagcccaatttaaaacatttgagaaagtagatggtgtgtatactaattttaaattgataggacacaccatctgtgatattcttaatgctaagttgggttttgatagctctaaagagtttgttgaatataaagttactgagtggccaacagctacaggtgatgtggtgttggctactgatgatttgtatgttaagagatacgaaaggggttgtattacttttggtaaacctgttatatggttaagccatgagcaagcttccctcaattctttaacatattttaatagacctttattggttgatgagaataaatttgatgttttaaaagtggatgatgttgacgatggtggtgatatctcagagagtgatgccaaagaatccaaagaaatcaacattattaagttaagtggtgttaaaaaaccatttaaggttgaagatagtgtcatagttaatgatgatactagtgaaatcaaatatgttaagagtttgtctatagttgatgtgtatgatatgtggcttacaggttgtaggtatgttgttagaactgctaatgctttgagcatggcagttaacgtacctacaatacgtaagtttataaaatttggtatgactcttgttagtataccaattgatttgttaaatttaagagagattaagcctgtttttaatgtggttaaagctgtgcgaaataaaatttctgcatgctttaattttattaaatggctttttgtcttattatttggctggattaaaatatccgctgataataaagtaatttacaccacagaagttgcatcaaagcttacatgtaagcttgtagctttagcttttaaaaatgcgtttttgacatttaagtggagtgtggttgctagaggtgcttgcattatagcgactatatttctattgtggtttaattttatatatgccaatgtaatttttagtgatttttatttgcctaaaattggtttcttgccgacttttgttggtaagatcgcacagtggattaagagcacttttagtcttgtaactatttgtgatctatattccattcaggatgtgggttttaagaatcagtattgtaatggaagtatcgcatgtcaattctgcttggcaggatttgatatgttagataattataaagccattgatgtagtacagtatgaagctgataggagagcatttgttgattatacaggtgtgttaaagattgtcattgaattgatagttagttacgccctgtatacggcatggttctacccattgtttgctcttattagtattcagatcttgaccacttggctgcctgagctttttatgcttagtacattacattggagtgttaggttgctggtgtctttagctaatatgttaccagcacatgtgtttatgaggttttatattattattgcctcttttattaagctgtttatcttgtttaggcatgttgcctatggttgtagtaaacctggttgtttgttttgttacaagaggaatcgtagtctacgtgttaaatgtagtactattgttggtggcatgatacgctattacgatgttatggctaatggtggcactggcttttgttcaaaacatcaatggaattgcattgattgtgattcttataaaccaggtaatacttttattactgttgaggccgctcttgatttatctaaggaattgaaacggcctattcagcctacagatgttgcttatcatacggttacggatgttaagcaagttggttgttatatgcgcttgttctatgagcgtgatggacagcgcacatatgatgatgttaatgctagtttgtttgtggattatagtaatttgctacattctaaggttaagggtgtgcctaatatgcatgttgtggtagtggaaaatgatgccgataaagctaattttcttaatgctgctgtattttatgcacagtctttgtttagacctattttaatggttgataaaaatctgataactactgctaatactggtacgtctgttacagaaactatgtttgatgtttatgtggacacatttttgtctatgtttgatgtggataaaaagagtcttaatgctttaatagcaactgcgcattcttctataaaacagggtacgcagatttgtaaagttttggatacctttttaagctgtgctcgtaaaagttgttctattgattcagatgttgatactaagtgtttagctgattctgtcatgtctgctgtatcggcaggccttgaattgacggatgaaagttgtaataacttggtgccaacatatttgaagggtgataacattgtggcagctgatttaggtgttctgattcaaaattctgctaagcatgtgcagggtaatgttgctaaaatagccggtgtttcctgtatatggtctgtggatgcttttaatcagctaagttctgatttccagcataaattgaagaaagcatgttgtaaaactggtttgaaattgaagcttacttataataagcagatggctaatgtctctgttttaactacaccctttagtcttaaagggggtgcagtttttagttattttgtttatgtatgttttctgttgagtttggtttgttttattggattgtggtgcttaatgcccacttacacagtacacaaatcagattttcagcttcccgtttatgccagttataaagttttagataatggtgttattagagatgttagcgttgaagatgtttgtttcgctaacaaatttgaacaatttgatcaatggtatgagtctacatttggtctaagttattatagtaacagtatggcttgtcccattgttgttgctgtagtagaccaggatcttggctctactgtgtttaatgtccctaccaaagtgttacgatatggttaccatgtgttgcactttattacacatgcactttctgctgatggagtgcagtgttatacgccacatagtcaaatatcgtattctaatttttatgctagtggctgtgtgctttcctccgcttgtactatgtttgcaatggccgatggtagtccacaaccttattgttatacagaggggcttatgcagaatgcttctctgtatagttcattggtacctcacgtgcggtataatcttgctaatgctaaaggttttatccgttttccagaagtgttgcgagaaggacttgtgcgtattgtgcgtactcgttctatgtcgtattgcagagttggattatgtgaggaagctgatgagggtatatgctttaactttaatggttcttgggtgcttaataatgattattatagatcattgcctgggaccttttgtggtagagatgtttttgacttaatttatcagctttttaaaggtttagcacagcctgtggatttcttggcattgactgctagttctattgctggtgctatacttgctgtaattgttgttttggtgttttattacttaataaagcttaaacgtgcttttggtgattacaccagtattgtttttgtcaatgtgattgtgtggtgtgtaaattttatgatgctttttgtgtttcaagtttaccctacactttcttgtgtatatgctatttgttatttttatgccacgctttatttcccttcggagataagtgtgataatgcatttacaatggctagttatgtatggcactattatgcctttatggttttgtttgctatatatatctgttgttgtttcaaatcatgctttttgggtattcgcttactgcagacggcttggtacttctgttcgtagtgatggtacatttgaagaaatggctcttactacttttatgattacaaaagattcttattgtaagcttaagaattctttgtctgatgttgcttttaatagatatttgagtttgtataataaatataggtattacagcggtaaaatggatactgctgcatatagggaggctgcttgttcgcagttggctaaagcaatggatacatttaccaataataatggtagtgatgtgctttaccaaccacctactgcttccgtttcaacttcattcttgcaatctggtattgtgaaaatggttaatcctacttctaaggtagaaccatgtattgtcagtgttacctatggtaatatgacattgaatggtttatggttggatgataaggtctactgtcccagacatgtgatatgttctgcttcagatatgactaatccagattatacaaatttgttgtgtagagtaacatcaagtgattttactgtattgtttgatcgtttaagccttacagtgatgtcttatcaaatgcagggttgtatgcttgttcttacagtgaccctgcaaaattctcgtacgccaaaatatacatttggtgtggttaaacctggtgagacttttactgttttagctgcttataacggcaaaccacaaggagcctttcatgtgactatgcgtagtagttataccattaagggttcctttttatgcggatcttgtgggtctgttggttatgtgctaatgggtgattgtgttaaatttgtgtatatgcatcaattggagcttagtactggttgtcatactggtactgatttcaatggggatttttatggtccttataaggatgctcaggttgtccaattgcccgttcaggattatatacaatctgttaattttgtagcatggctttatgctgctatacttaataattgtaattggtttgtacaaagtgataagtgttctgttgaagattttaatgtgtgggctttgtctaatgggtttagccaagttaaatctgatcttgttatagatgctttagcttctatgactggtgtgtctttggaaacattattggctgctattaagcgtctcaagaatggttttcaaggacgtcagattatgggtagttgctcctttgaggatgaattgacacctagcgatgtttatcaacaactcgctggtatcaagttacaatcaaagcgtactagattggttaaaggcattgtttgttggattatggcttctacatttttgtttagttgtataattacagcatttgtgaaatggactatgtttatgtatgtaactactaatatgcttagtattacgttttgtgcactttgtgttataagtttggccatgttgttggttaaacataagcatctttatttgactatgtatataattcctgtgctttttacactgctgtataacaactatttggttgtgtacaagcagacatttagaggctatgtttatgcatggctatcatattatgttccatcagttgagtatacttatactgatgaagttatttacggcatgttattgcttataggaatggtctttgttacattacgtagcattaaccatgatttgttttcttttataatgtttgttggtcgtgtgatttctgttgtctctttgtggtacatgggttctaacttagaggaagaaattcttcttatgttggcttctctttttggtacttacacatggacaacagctttatctatggctgcagcaaaggttattgctaagtgggttgctgtgaatgttttgtatttcacagatatacctcaaattaagatagttcttgtatgctatttgtttataggttatattattagctgttattggggtttgttttccttgatgaacagtttgtttagaatgcctttgggtgtttataattataaaatttcagtacaggaattaagatatatgaatgctaatggattgcgccctcctaagaatagttttgaagcccttatgcttaattttaagcttttgggtattggaggtgtgccaattattgaagtatctcaatttcaatcaaaattgactgatgttaaatgtgctaatgttgtcttgcttaattgcttgcaacatttgcatgttgcttctaattctaagttgtggcagtattgtagcactttgcacaatgaaatacttgccacttctgatctgggtgttgcttttgaaaagcttgctcagttgttaattgttttgtttgctaatccagctgctgtggatagcaagtgcctgactagtattgaagaagtttgcgatgattacgcaaaggacaatactgttttgcaggctttacagagtgaatttgttaatatggctagcttcgttgaatatgaagttgctaagaaaaatcttgatgaggcgcgttctagtggttctgctaatcaacagcagttaaaacagctagagaaagcctgtaatattgctaaatctgcttatgaacgcgaccgtgctgtagcaagaaagttggagcgtatggcagatttggctctcactaatatgtataaagaagctagaattaatgataagaagagtaaggttgtttctgccttgcaaactatgctttttagtatggtgcgtaagttagataatcaagctctgaattcaatattagataatgctgtgaagggttgtgtaccattgaatgcaatcccttcattggctgcaaatactctgactataattgtaccagataaaagtgtttacgatcaggtagttgacaatgtctatgttacctatgcgggtaatgtatggcagattcaaactatccaagattcagatggtacaaataagcagttgaatgagatatctgatgattgtaactggccactagttattattgcaaatcggcataatgaggtatctgcaaccgttttgcaaaataatgaattaatgcctgctaagttgaaaactcaggtcgttaatagtggtccagatcagacttgtaacacacctactcaatgttactataataatagtaacaatgggaagattgtttatgctatacttagtgatgttgatggtcttaagtatacaaagattcttaaagatgatggcaattttgttgttttggagttagatcctccttgtaaatttactgttcaagatgttaaaggtcttaaaattaagtacctttattttgtaaaaggttgtaacacactagcaagaggctgggttgttggtacaatttcttctacagttagattgcaagctggaactgctactgagtatgcttccaactcatctatattatctttatgtgcgttttctgtagatcctaagaaaacgtatttagattttatacagcagggaggaacacctattgccaattgtgttaaaatgttgtgtgaccatgctggtaccggtatggccattactgttaaacccgatgctaccactaatcaggattcatatggtggtgcgtctgtttgtatatattgccgcgcacgagttgaacacccagatgttgatgggttgtgcaaattacgcggcaagtttgtacaagtgcctgtaggtataaaagatcctgtgtcttatgttttgacacatgatgtttgtcaagtttgtggattttggcgggatggaagttgttcatgtgttagcactgacactactgttcagtcaaaagatactaattttttaaacgggttcggggtacgagtgtagatgcccgtctcgtaccctgtgccagtggtttatctactgatgtacaattaagggcatttgatatttgcaatgctagtgttgctggcattggtttacatttaaaagttaattgctgccgttttcagcgtgttgatgagaacggtgataaattagatcagttctttgttgttaagaggacagatctgactatatataatagagagatggaatgctatgagcgtgtaaaagattgtaagtttgtggctgaacacgatttctttacatttgatgtagaaggtagtcgtgtgccacatattgtacgcaaggatttaacaaagtatactatgttggatctttgctatgcgttgcgacattttgatcgcaatgattgcatgctgctttgtgacattctctctatatatgctggttgtgaacaatcctactttactaagaaggattggtatgattttgttgaaaatcctgatattattaatgtttataaaaagctaggacctatttttaatagagccctagttagcgctactgagtttgcagacaaattggtggaggtaggcttagtaggcattttaacacttgataaccaagatttaaatggtaaatggtatgattttggtgactatgttattgcagccccaggttgtggtgttgctatagcagactcttattattcttatatgatgcctatgctgaccatgtgtcatgcattggattgtgaattgtatgtgaataatgcttatagactatttgatcttgtacagtatgattttactgattacaagctcgaattgtttaataagtattttaagcactggagtatgccataccatcctaacacggttgattgtcaggatgatcggtgtatcatacattgtgctaattttaacatactttttagtatggttttacctaatacatgttttgggcctcttgttaggcaaatttttgtggatggtgttccttttgttgtttcaattggataccattataaagaacttggtattgtgatgaatatggatgtggatacacatcgttatcgcttgtctttaaaagacttgcttttatatgctgctgatccagctttgcatgtagcttctgctagtgcattgtatgatttacgcacttgctgttttagtgttgcggctataacaagcggtgtaaaatttcaaacagttaaacctggtaattttaatcaggatttttatgattttattttaagtaagggcctgcttaaagagggtagttcagttgatctgaagcactttttctttacgcaggatggtaatgctgctatcactgattataattattataagtacaatttgcccaccatggtggacattaagcagttgttgtttgttttggaagttgtttataagtattttgagatttatgatggtgggtgtataccggcatcacaagtcattgttaataattatgataagagtgctggctatccatttaataaatttggaaaagccaggctctattatgaagcattatcatttgaggagcaggatgaaatttacgcctatactaagcgcaatgtcctgccaacacttactcaaatgaatttgaaatatgctattagtgctaagaatagagcccgcactgtcgctggtgtttccatacttagtactatgactggcagaatgtttcatcaaaagtgtttgaaaagtatagcagctacacgtggtgttcctgttgttataggcaccactaaattttatggcggctgggatgatatgttacgtcgccttattaaagatgttgataatcctgtacttatgggttgggattatcctaagtgtgatcgtgctatgccaaacatactacgtattgttagtagtctggttttggctcgaaaacatgaggcatgttgttcgcaaagcgataggttttatcgacttgcgaatgaatgcgcacaagttctgagtgaaattgttatgtgtggtggctgttattatgttaagcctggtggcactagtagtggtgatgcaactactgcttttgctaattcagtttttaacatatgtcaagctgtttcagccaatgtatgtgctttaatgtcatgcaatggtaataagattgaagatttgagtatacgtgctcttcagaagcgcttatactcacatgtgtatagaagtgatatggttgattcaacctttgtcacagaatattatgaatttttaaataagcattttagtatgatgattttgagtgatgatggcgttgtgtgttataattctgactatgcgtccaaagggtatattgctaatataagtgcctttcaacaggtattgtattatcaaaataacgtttttatgtcagaatccaaatgttgggttgaaaatgacataaataatggacctcatgaattctgttcacaacacacaatgcttgtaaagatggatggggacgatgtctatcttccatatcctgatcctagtcgtatattaggagctggatgttttgtagatgatttgttaaagactgatagtgttcttttaatagaacgatttgtaagtcttgcaatagatgcttatccacttgtgtaccacgaaaatgaagaataccaaaaggtttttcgtgtttatttggagtatataaagaagttgtacaatgacctgggtaatcagatcttggatagctacagtgttattttaagtacttgtgatggacaaaagtttactgatgagtccttttacaagaacatgtatttaagaagtgcagttatgcagagtgttggagcttgcgtggtctgctcttctcaaacatcattacgttgtggcagttgcatcagaaagcctcttctttgctgcaagtgttgttacgatcatgttatggcaactgatcataaatatgttttgagtgtttcaccatatgtgtgtaatgcaccaggatgtgatgtaaatgatgttaccaaattgtatctaggtggtatgtcatattattgtgaagatcataagccacaatattcgtttaagttggtaatgaatggtatggtttttggtctatataaacaatcttgtacaggatctccgtacatagatgattttaatcgtatagctagttgtaaatggactgatgttgatgattacatactggctaatgaatgtacagagcgcttgaaattgtttgctgcagaaacgcaaaaggcgactgaggaagcctttaagcagagttatgcatcagcaacaatacaagagattgttagcgagcgcgaattgatcctctcttgggagattggaaaagtgaagccaccacttaataaaaattatgtttttactggctaccattttactaaaaatggcaagacagttttaggtgagtatgtttttgataagagtgagttgactaatggtgtgtattatcgcgccacaaccacttataagctatctgttggagatgtttttgttttaacctctcattcagtagctaatttaagtgctcctacgctggtgccgcaggagaattatagtagtattagattcgctagtgtttatagtgtgcttgagacgtttcagaacaatgtcgttaattatcaacacattggtatgaaacgttattgcaccgtgcaaggacctcctggtacaggaaagtcacatcttgctattggtcttgctgtttattattgtacagcacgtgtagtatacactgcggccagccatgcagctgttgacgcattgtgtgaaaaagcatacaaatttttgaatataaatgactgcactcgtattgttcctgccaaggtcagggtggagtgctatgataagtttaaaattaatgacaccactcgtaagtatgtgtttactactataaatgcattacctgagatggtgactgatattgttgttgtagatgaagttagtatgcttaccaattatgagctttctgttattaatgctcgtattcgtgctaagcattatgtttacattggtgatcctgctcaattgccagcaccacgtgtgttattgagcaagggtacacttgaacctaaatattttaacactgttactaagcttatgtgttgcttagggccagacatttttcttggtacatgttatagatgtcctaaggaaattgttgatacagtgtctgccttggtttatgaaaataagcttaaggctaagaatgaaagtagttcattgtgttttaaggtctattataaaggcgttacaacacatgaaagttctagtgctgtaaatatgcagcagatttatttgattaataagtttttgaaggctaaccctttgtggcataaagccgtttttattagcccatataatagccagaactttgcagctaagcgtgttttgggtttgcaaacccagaccgtggattctgctcaaggttctgaatatgattatgttatatattcacagactgcagaaacagcgcattctgtaaatgttaatcgcttcaatgttgctattactcgagccaagaaaggtattctttgtgttatgagtaatatgcagttgtttgaagcattacagtttactacattgaccttagataaagtgccacaggccgttgaaacgagagttcaatgtagtaccaatttatttaaagattgtagcaagagttatagtggttaccacccagctcacgctccttcatttttggcagtagatgacaaatataaggcaactggcgatttagccgtgtgtcttggtattggagattctgctgttacatattcaagattaatatcactcatgggttttaaacttgatgtcacccttgatgggtattgtaagctttttataactaaagaagaagctgttaaacgcgtgcgtgcttgggttggctttgatgctgaaggcgctcatgccacgcgtgatagcattgggacaaatttcccacttcaattagggttttctacaggaattgattttgttgtggaagccactggtttgtttgctgatagagatggttacagctttaaaaaggctgtggctaaagctcctcctggtgaacaatttaagcatctcatccctttgatgacgagaggtcagcgctgggatgttgttagacctagaatagtacaaatgtttgcagatcatttaattgatctgtctgattgtgttgtgctagttacatgggcagccaactttgagctcacttgtctccgatactttgcaaaagtaggtcgtgagatctcttgtaatgtgtgcactaaacgtgccacagcttacaattctagaactggttactatggttgttggcgccatagtgttacatgtgattacttgtataatccacttattgttgatattcaacagtggggatatattggatctttatcaagtaatcatgatttatattgtagtgtccacaaaggagcacatgttgcttcatctgatgctataatgacacggtgtttggccgtttatgattgtttttgcaataatattaattggaatgtggagtatcccattatttcaaatgagttaagtattaatacctcttgtagggtcttgcagcgtgttatgcttaaagctgcaatgctctgcaacagatatactttgtgttatgatattggcaacccaaaagcgattgcctgtgtcaaagattttgattttaagttctatgatgcccaaccaattgttaagtctgtcaagactcttttgtattcttttgaggcacataaggactcttttaaagatggtttgtgtatgttttggaactgtaatgtggataagtatccaccgaatgcagttgtatgtagatttgacacgagagtgttgaataatttaaatcttcctggctgtaatggaggtagtttgtatgttaataaacatgcattccacactaaacccttttctagggcagcctttgagcatttgaagcctatgccatttttctattattcagatacgccttgtgtgtatatggatggcatggatgctaagcaggttgattatgtacctttgaaatccgccacttgcatcacaagatgcaatttaggtggtgcagtttgtttaaaacatgctgaagagtatcgtgagtacctagagtcttacaatacagctactacagcaggttttactttttgggtctataagacatttgatttttataatttgtggaatacgttcaccaagctacaaagcttggagaacgttgtatataatttagtcaaaactggtcattatacaggacaggctggtgaaatgccttgtgccattataaatgataaagtcgtggctaagatcgataaggaggatgttgtcatttttattaataatacaacataccctactaatgttgctgttgaattatttgccaagcgcagtattcgacaccatccagagcttaagctctttagaaatttgaatatagacgtgtgttggaagcacgtcatttgggattatgctagagaaagtatattttgcagtaatacctatggtgtctgcatgtatacagatttaaagttcattgataaattgaatgtcctttttgatggtcgtgataatggtgctcttgaagcttttaaacgctctaataatggcgtttacatttccacgacaaaagttaagagtctttcgatgataaaaggtccaccgcgtgctgaattaaatggcgtagtggtggacaaggttggagacactgattgtgtgttttattttgctgtgcgtaaagagggtcaggatgtcatcttcagccaattcgacagcctgagagtcagctctaaccagagcccacaaggtaatctggggagtaatgaacccggtaatgtcggtggtaatgatgctctggcaacctccactatctttacacaaagccgtgttattagctcttttacatgtcgtactgatatggaaaaagattttatagctttagatcaagacttgtttattcagaagtatggtttggaggactatgcctttgaacacattgtttatggtaatttcaaccagaagattattggtggtttgcatttgttaataggcttgtaccgaagacagcaaacttccaatctggttattcaggagtttgtttcatacgactccagcatacactcttattttatcactgatgagaagagtggtggtagtaagagtgtttgcactgttatagatattttgttggatgattttgtggctcttgttaagtcacttaatctcaactgtgtgagtaaggttgttaacgttaatgttgattttaaagattttcagttcatgctttggtgtaacgatgagaaagttatgactttctatcctcgtttgcaagctgcatctgactggaagcctggttattctatgcctgtattatacaagtatttgaattccccaatggaaagagttagtctctggaattatgggaagccggttactttgcctacaggctgtatgatgaatgttgctaagtatactcagttatgtcaatatctgaatactacaacattagctgtacctgttaatatgcgagttttgcatttaggtgcaggttcagaaaaaggagtagcaccgggttctgcagttcttaggcagtggttgcctgctggtactattcttgtagataatgatttatacccatttgtgagtgacagtgtcgctacatattttggggattgtataaccttaccctttgattgtcaatgggatttgataatttctgatatgtatgaccctattactaagaacataggggagtacaatgtaagtaaagatggtttctttacatacatttgtcatatgattcgcgacaagttagctctgggtggcagtgttgctataaaaataacagagttttcttggaatgcagaattatataagttaatggggtattttgcattttggacggttttctgcacaaatgcaaacgcttcttctagtgaagggtttttaattggcataaattatttgggtaagcccaaggttgagatagatggaaatgttatgcatgccaattatttgttttggagaaattccacagtttggaacgggggtgcttatagcctgtttgacatggctaaattcccgcttaagttggctggtactgccgtaataaatttaagagcagaccagattaatgatatggtttattcccttcttgaaaagggtaaactacttgttagagatacaaataaagaagtttttgttggtgacagtttggttaatgtaatctaaactttaagaatggcagtcgcttatgcagacaagcctaatcactttatcaattttccacttacccagtttcagggctttgtgttaaattataaaggtttacaatttcaacttctcgatgaaggagtggattgtaaaatacaaacagcgcctcacattagtcttgctatgctggatattcagcctgaagactacagaagtgttgatgttgctattcaagaagttattgatgatatgcattggggtgagggctttcagattaaatttgaaaacccccatatcctaggaagatgcatagttttagatgttaaaggtgtagaagaattgcatgatgatttagttaattacattcgtgataaaggttgtgttgctgaccaatccaggaagtggattggacattgcaccatagcccaactcactgatgctgcactttccattaaggaaaatgttgattttataaacaacatgcaattcaactataaaatcactatcaatccctcatcaccggctagacttgaaatagttaagcttggtgctgaaaggaaagatggtttttatgaaaccatagctagccactggatgggaattcgttttgaatataatccacccactgataagctagctatgattatgggttattgttgtttagaagtggtgcgtaaagagctagaagaaggtgaccttcccgagaatgatgatgatgcttggtttaagctatcgtaccattatgaaaacaattcttggttctttcgacatgtctacaggaaaagttcttatttccgtaagtcttgtcaaaatttagattgtaattgtttggggttttatgaatcttcagttgaagaagactaaactcagtgaaaatgtttttgcttcctagatttgttctagttagctgcataattggtagcctaggttttgacaaccctcctaccaatgttgtttcgcatttaaatggagattggtttttatttggtgacagtcgttcagattgtaatcatgttgttactaccaacccccgtaattattcttatatggaccttaatcctgccttgtgtggttctggtaaaatatcatctaaagctggcaactccatttttaggagttttcactttaccgatttttataattacacaggcgaaggtcaacaaattattttctatgagggtgttaattttacgccttatcatgcctttaaatgcaccacttctggtagtaatgatatttggatgcagaataaaggcttgttttacactcaggtttataagaatatggctgtgtatcgcagccttacttttgttaatgtaccatatgtttataatggctctgcacaatctacagccctttgtaaatctggtagtttagttcttaataaccctgcatatatagctcgtgaagctaattttggggattattattataaggttgaagctgatttttatttgtcaggttgtgacgagtatatcgtaccactttgtattttcaacggcaagtttttgtcgaatacaaagtattatgatgatagtcaatattattttaataaagacactggtgttatttatggtctcaattctactgaaaccattaccactggttttgactttaattgtcattatttagttctaccctctggtaattatttagccatttcaaatgagctattgttaactgttcctactaaagcaatctgtcttaataagcgtaaggattttacgcctgtacaggttgttgattcgcggtggaacaatgccaggcagtctgataacatgacggcagttgcttgtcaacccccgtactgttattttcgtaattctactaccaattatgttggtgtttatgatatcaatcatggggatgctggttttactagcatactcagtggtttgttatatgactcaccttgtttttcgcagcaaggtgtttttaggtatgataatgttagcagtgtctggcctctctacccctatggcagatgccctactgctgctgatattaatacccctgatgtacctatttgtgtgtatgatccgctaccaattattttgcttggcattcttttgggtgttgcggtcataattattgtagttttgttgttatattttatggtggataatggtactaggctgcatgatgcttagaccataatctaaacatgtttttgatacttttaatttccttaccaacggcttttgctgttataggagatttaaagtgtactacagtttccattaatgatgttgacactggtgttccttctattagcactgatactgtcgatgttactaatggtttaggtacttattatgttttagatcgtgtgtatttaaatactacgttgttgcttaatggttactaccctacttcaggttctacatatcgtaatatggcactgaagggaactttactattgagcacactgtggtttaaaccaccttttctttctgattttactaatggtatttttgctaaggtcaaaaataccaaggttattaaagatggtgtaatgtatagtgagtttcctgctataactataggtagtacttttgtaaatacatcttatagtgtggtagtacaaccacatactaccattttgggtaataaattacaaggtttcttagagatctctgtttgccagtatactatgtgcgagtacccaaatacgatttgtaatcctaatctgggtaatcaacgcgtagaactatggcattgggatacaggtgttgtttcctgtttatataagcgtaatttcacatacgatgtgaatgctgattatttgtatttccatttttatcaagaaggtggtactttttatgcatattttacagacactggtgttgttactaagtttctgtttaatgtttatttaggcacggtgctctcacattattatgtcatgcctttgacttgtaatagtgctctgactttagaatattgggttacacccctcacttctaaacaatatctactagctttcaatcaagatggtgttatttttaatgctgttgattgtaagagtgattttatgagtgagattaagtgtaaaacactatctatagcaccatctactggtgtttatgaattaaacggttacactgttcagccaattgcagatgtttaccgacgtatacctaatcttcccgattgcaatattgaggcttggcttaatgataagtcggtgccctctccattaaattgggaacgtaagaccttttcaaattgtaattttaatatgagcagcctgatgtcttttattcaggcatactcatttacttgtaataatattgatgctgctaagatatatggtatgtgtttttccagcataactatagataagtttgcaatacccaatggtaggaaggttgacctacaattgggtaatttgggctatttgcagtcttttaattatagaattgatactactgctacaagttgtcagttgtattataatttacctgctgctaatgtttctgttagcaggtttaatccttctacttggaataggagatttggttttacagaacaatctgtttttaagcctcaacctgcaggtgtttttactgatcatgatgttgtttatgcacaacattgttttaaagcttccacaaatttctgtccgtgtaaattggatgggtctttgtgtgtaggtaatggtcctggtatagatgctggttataaaactagtggcataggcacttgtcctgcaggtactaattatttaacttgccataatgctgcccaatgtgattgtttgtgcaccccagaccccattacatctaaagctacagggccttacaagtgcccccaaactaaatatttagttggcataggtgagcactgttcgggtcttgctattaaaagtgatcattgtggaggtaatccttgtacttgccaaccacaagcatttttgggttggtctgttgactcttgtttacaaggggataggtgtaatatttttgctaattttattttgcatgatgttaatagtggtactacttgttctactgatttacaaaaatcaaacacagacataattcttggtgtttgtgttaattatgatctttatggtattactggccaaggtatttttgttgaggttaatgcgacttattataatagttggcagaaccttttatatgattctaatggtaatctctatggttttagagactacttaacaaatagaacttttatgattcgtagttgctatagtggtcgtgtttcagcggcctttcatgctaactcttccgaaccagcattgctatttcggaatatcaaatgcaattacgtttttaataacactctttcacgacagctgcaacctattaactattttgatagctatcttggttgtgttgtcaatgctgataatagtacttctagtgttgttcaaacatgtgatctcacagtaggtagtggttactgtgtggattactctacaaaaagacgaagtcgtagatcgattaccactggttatcggtttactaattttgagccatttactgttaattcagtaaatgatagtttagaacctgtaggtggtttgtatgaaattcaaataccttcagagtttactataggtaatatggaggagtttattcaaacaagctctcctaaagttactattgattgttctgcttttgtctgtggtgattatgcagcatgtaaatcacagttggttgaatatggtagcttctgtgacaatattaatgctatactcacagaagtaaatgaactacttgacactacacagttgcaagtagctaatagtttaatgaatggtgtcactcttagcactaagcttaaagatggcgttaatttcaatgtagacgacatcaatttttcccctgtattaggttgtttaggaagcgattgcaataaagtttccagtagatctgctatagaggacttacttttttctaaagtaaagttatctgatgtcggtttcgttgaggcttataataattgtactggaggtgccgaaattagggacctcatttgtgtgcaaagttataatggtatcaaggtgttgcctccactgctctcggaaaatcagatcagtggatacactttggctgccacttctgctagcctgtttcctccatggtcagcagcagcaggtgtaccattctatttaaacgttcagtatcgtattaatggtattggtgttaccatggatgtgttaagtcaaaatcaaaagcttattgctaatgcatttaacaatgctcttggtgctattcaggaagggtttgatgctaccaattctgctttagttaaaattcaagctgttgttaatgcaaatgctgaagctcttaataacttattgcaacaactctctaatagatttggtgctataagttcttctttacaagaaattctatctagactggatgctcttgaagcgcaagctcagatagacagacttattaatgggcgtcttaccgctcttaatgcttatgtttctcaacagcttagtgactctacactagtaaagtttagtgcagcacaagctatggagaaggttaatgaatgtgtcaaaagccaatcatctaggataaatttttgtggtaatggtaatcatattatatcattagtgcagaatgctccatatggtttgtattttatccactttagctatgtccctactaagtatgtcactgcgaaggttagtcccggcctgtgcattgctggtgatagaggtatagcccctaagagtggttattttgttaatgtaaataatacttggatgttcactggtagtggttattactaccctgaacctataactggaaataatgttgttgttatgagtacctgtgctgttaattatactaaagcgccggatgtaatgctgaacatttcaacacccaacctcccttattttaaggaagagttggatcaatggtttaaaaaccaaacatcagtggcaccagatttgtcacttgattatataaatgttacattcttggacctacaagatgaaatgaataggttacaggaggcaataaaagttttaaatcagagctacatcaatctcaaggacattggtacatatgagtattatgtaaaatggccttggtatgtatggcttttaattggctttgctggtgtagctatgcttgttttactattcttcatatgctgttgtacaggatgtgggactagttgttttaagaaatgtggtggttgttgtgatgattatactggacaccaggagttagtaattaaaacatcacatgaagactaagttcgtctttgatttattgactcctgacgatatattacatccctccaatcatgtgaatctaattataagacccatttaggtcgagcatattataatagctaccacaatgcctgctgtttagtgggtactgtgtcttatataactagtaaacctgcaatgccaatggctacaaccattgaaggtgcagattatactaacattatgcctattactgttcttacaacagtttatttaggcgtttctataggtattgacactagcaccactggttttacctgtttttcatggtactagttccaaaccatattataatttaggtagaccttataactttaagcattattgccaaagtttttaaggccacgccctagtaatggacatctggaaacctgagattaaatatctccgttatactaacggttttaatgtctcagaattagaagatgcttgttttaaatttaactataaatttcctaaagtaggatattgtagagttcctagtcatgcttggtgccgtaatcaaggtagcttttgtgctacactcactctttatggcaaatccaaacattatgataaatattttggagtaataactggttttacagcattcgctaatactgtagaggaggctgtcaacaaactggttttcttagctgttgactttattacctggcgtagacaggagttaaatgtttatggctgatgcttattttgcagacactgtgtggtatgtggggcaaataatttttatagttgccatttgtttattggttataatagttgtagtggcatttttggcaacttttaaattgtgtattcaactttgcggtatgtgtaataccttagtactgtccccttctatttatgtgtttaatagaggtaggcagttttatgagttttacaatgatgtaaaaccaccagttcttgatgtggatgacgtttagttaatccaaacattatgagtagtgtaactacaccagcaccagtttacacctggactgctgatgaagctattaaattcctaaaggaatggaacttttctttgggtattatactactttttattacagtcatattgcaatttggatatacaagtcgcagtatgtttgtttatgttattaagatggtcattttgtggcttatgtggccccttactatcatcttaactattttcaattgcgtgtatgcgttgaataatgtgtatcttggcttctctatagtttttactatagtggccattattatgtggattgtgtattttgtgaatagtatcaggttgtttattagaactggaagttggtggagtttcaacccagaaacaaacaacttgatgtgtatagatatgaagggaaggatgtatgttaggccgataattgaggactaccatacccttacggtcacaataatacgtggtcatctttacatgcaaggtataaaactaggtactggctattctttgtcagatttgccagcttatgtgactgttgctaaggtctcgcacctgctcacgtataagcgtggttttcttgacaagataggcgatactagtggttttgctgtttatgttaagtccaaagtcggtaattaccgactgccatcaacccaaaagggttctggcttggacaccgcattgttgagaaataatatctaaactttaaggatgtcttttactcctggtaagcaatccagtagtagagcgtcctctggaaatcgttctggtaatggcatccttaagtgggccgatcagtccgaccaatctagaaatgttcaaaccaggggtagaagagctcaacccaagcaaactgctacttctcagcaaccatcaggagggaatgttgtaccctactattcttggttctctggaattactcagtttcaaaagggaaaggagtttgaatttgcagagggacaaggtgtgcctattgcaccaggagtcccagctactgaagctaaggggtactggtacagacacaaccgacgttcctttaaaacagccgatggcaaccagcgtcaattgctaccacgatggtatttttactatcttggaacaggaccgcatgccaaagaccagtatggcaccgacattgacggagtctactgggtcgctagtaaccaggctgatgtcaataccccggctgacattctcgatcgggacccaagtagcgatgaggctattccgactaggtttccgcctggcacggtactccctcagggttactatattgaaggctcaggaaggtctgctcctaattccagatctacttcacgcgcatccagtagagcctctagtgcaggatcgcgcagtagagccaattctggcaatagaacccctacctctggtgtaacacctgatatggctgatcaaattgctagtcttgttctggctaaacttggcaaggatgccgctaagccacagcaagtaactaagcagactgccaaagaaatcagacagaaaattttgaataaaccccgccagaagaggagccccaataaacaatgcactgttcagcagtgttttgggaagagaggccccaatcagaattttggtggtggagaaatgttaaaacttggaactagtgatccacagttccccattcttgcagaactcgcacccacagctggtgcgtttttctttggatcaagattagagttggccaaagtgcagaatttgtctgggaatcttgacgagccccagaaggatgtttatgaattgcgctataatggcgcaattagatttgatagtacactttcaggttttgagaccataatgaaggtgttgaatgagaatttgaatgcataccaacaacaggatggtacgatgaatatgagtccaaaaccacagcgtcagcgtggtcagaagaacggacaaggagaaaatgataatataagtgttgcagcgcccaaaagccgtgtgcagcaaaataagattagagagttgactgcagaggacatcagccttcttaagaagatggatgagccctttactgaagacacctcagaaatataagagaatgaaccttatgtcggcacctggtggtaacccctcgcaggaaagtcgggataaggcactctctatcagaatggatgtcttgctgctataatagatagagaaggttatagcagactatagattaattagttgaaagttttgtgtggtaatgtatagtgttggagaaagtgaaagacttgcggaagtaattgccgacaagtgcccaaggggaagagccagcatgttaagttaccatccagtaattagtaaatgaatgaagttaattatggccaattggaagaatcac

SEQ ID NO: 22 - DNA, 31028 bp, Coronavirus
gattgcgagcgatttgcgtgcgtgcatcccgcttcactgatctcttgttagatcttttcataatctaaactttataaaaacatccactccctgtagtctatgcctgtgggcgtagatttttcatagtggtgtctatattcatttctgctgttaacagctttcagccagggacgtgttgtatcctaggcagtggcccacccataggtcacaatgtcgaagatcaacaaatacggtctcgaactacactgggctccagaatttccatggatgtttgaggacgcagaggagaagttggacaaccctagtagttcagaggtggatatagtatgctccaccactgcgcaaaagctggaaacaggcggaatttgtcctgaaaatcatgtgatggtggattgtcgccgacttcttaaacaagaatgttgtgtgcagtctagcctaatacgtgaaattgttatgaatacacgtccatatgatttggaggtgctacttcaagatgctttgcagtcccgcgaagcagttttggttacaccccctctaggtatgtctctggaggcatgctatgtgagaggttgtaatcctaatggatggaccatgggtttgtttcggcgtagaagtgtgtgtaacactggtcgctgcgctgttaacaagcatgtggcctatcagctatatatgattgatcctgcgggtgtctgttttggtgcaggtcaatttgtgggttgggttatacccttagcctttatgcctgtgcaatcccggaaatttattgttccttgggttatgtacttgcgtaagtgtggcgaaaagggtgcctacaacaaagatcataaacgtggcggttttgaacacgtttataattttaaagttgaggatgcttacgacttggttcatgatgagcctaagggtaagttttctaagaaggcttatgctttaattagaggataccgtggtgttaaaccgcttctttatgtagaccagtatggttgtgattatactggtggtcttgcagatggcttagaggcttatgctgataagacattgcaagaaatgaaggcattatttcctatttggagccaggaactcccttttgatgtaactgtggcatggcacgttgtgcgtgatccacgttatgttatgagactgcagagtgcttctactatacgtagtgttgcatatgttgctaaccctactgaagacttgtgtgatggttctgttgtcataaaggaacctgtgcatgtttatgcggatgactctattattttacgtcaacataatttagttgacattatgagttgtttttatatggaggcagatgcagttgtaaatgctttttatggtgttgatttgaaagattgtggttttgttatgcagtttggttatattgactgcgaacaagacttgtgtgattttaaaggttgggttcctggtaatatgatagatggttttgcttgcactacttgtggtcatgtctatgagacaggtgatttgctagcacaatcttcaggtgttctgcctgttaatcctgtattgcatactaagagtgcagcaggttatggtggttttggttgtaaggattcttttaccctgtatggccaaactgtagtttattttggaggttgtgtgtattggagtccagcacgtaatatatggattcctatattaaaatcttctgttaagtcttatgacggtttggtttatactggagttgtaggttgcaaggctattgtaaaggaaacaaatctcatttgcaaagcgttgtaccttgattatgttcaacacaagtgtggcaatttacaccagcgggagttgctaggtgtgtcagatgtgtggcataaacaattgttattaaatagaggtgtgtacaaacctcttttagagaatattgattattttaatatgcggcgcgctaaatttagtttagaaacttttactgtttgtgcagatggttttatgccttttcttttagatgatttggttccgcgcgcatattatttggcagtaagtggtcaagcattttgtgactacgcagataaaatctgccatgctgttgtgtctaagagtaaagagttacttgatgtgtctctggattctttaagtgcagctatacattatttgaattctaaaattgttgatttggctcaacattttagtgattttggaacaagttttgtttctaaaattgttcatttctttaagacttttactactagcactgctcttgcatttgcatgggttttatttcatgttttgcatggtgcttatatagtagtagagagtgatatatattttgttaaaaacattcctcgttatgctagtgctgttgcacaagcatttcggagtgttgctaaagttgtactggactctttaagagttacttttattgatggcctttcttgttttaagattggacgtagaagaatttgtctctcaggcagtaaaatttatgaagttgagcgtggcttgttacattcatctcaattgccattagatgtttatgatttaaccatgcctagtcaagttcagaaagccaagcaaaaacctatttatttaaaaggttctggttctgatttttcattagcagatagtgtggttgaagttgttacaacttcacttacaccatgtggttattctgaaccacctaaagttgcagataaaatttgcattgtggataatgtttatatggccaaggctggtgacaaatattaccctgttgtggttgatggtcatgtaggactcttggatcaagcatggagggttccttgtgctggaaggcgtgttacatttaaggaacagcctacagtaaatgagattgcaagcacacctaagactattaaagttttttatgagcttgacaaagattttaatactattttaaacactgcatgtggagtgtttgaagtagatgataccgtggatatggaggaattttatgctgtggtggttgatgccatagaagagaaactttctccatgtaaggagcttgaaggtgtaggtgctaaagttagtgcctttttacagaaattagaggataattccctatttttatttgatgaggctggcgaggaagttcttgcttctaaattgtattgtgcttttacagctcctgaagatgatgactttcttgaagaaagtggtgttgaagaagatgatgtagaaggtgaggaaactgatttaactgtcacaagtgctggagagccttgtgttgccagtgaacaggaggagtcttctgaaatcttagaggacactttggatgatggtccatgtgtggagacatctgattcacaagttgaagaagatgtagaaatgtcggattttgctgatcttgaatctgtgattcaggattatgaaaatgtttgttttgagttttatactacagagccagaatttgttaaagttttggatctgtatgtgcctaaagcaactcgcaacaattgctggttgcgatcagttttggcagtgatgcagaaactgccctgtcaatttaaagataaaaatttgcaggatctttgggtgttatataagcaacagtatagtcagttgtttgttgataccttggttaataagatacctgctaatattgtagttccacaaggtggttatgttgccgattttgcatattggttcttaaccttatgtgattggcagtgtgttgcatactggaaatgcattaaatgtgatttagctcttaagcttaaaggcttggatgctatgttcttttatggtgatgttgtctcacatgtgtgcaagtgtggtgagtctatggtacttattgatgttgatgtgccatttacagcccactttgctcttaaagataagttgttttgtgcatttattactaagcgtagtgtgtataaagcagcttgtgttgtggatgttaatgatagtcattctatggctgttgttgatggtaaacaaattgatgatcatcgtgtcactagtattactagtgataagtttgattttattattgggcatggtatgtcattttcaatgactactttcgaaattgcccaattgtatggttcttgtataacacctaatgtatgttttgttaaaggtgatataattaaagtttctaagcgtgttaaagcagaagtcgttgtaaatcctgctaatggccatatggcacatggtggtggtgttgcaaaggctattgcagtagcagctggacagcagtttgttaaagagactaccgatatggttaagtctaaaggagtttgtgctactggagactgttatgtctctacagggggtaaattatgtaaaactgtgcttaatgttgttggacctgatgcgagaacacagggtaaacaaagttatgcattgttagagcgtgtttataaacatcttaacaaatatgattgtgttgttacaactttgatatcagctggtatatttagtgtgccttctgatgtgtctttaacatatctacttggtactgccgagaaacaagttgttcttgttagcaataatcaagaggattttgatcttatttctaagtgtcagataactgccgttgagggcactaagaaattggcagagcgtctttcttttaatgtagggcgttctatcgtttacgaaacagatgctaataagttgattttaagcaatgacgttgcatttgtttcgacatttaatgtcttacaggatgttttatccttaagacatgatatagcacttgatgatgatgcacgaacctttgttcagagcaatgttgatgttgtacctgagggttggcgtgttgtcaataagttttaccaaattaatggtgttagaaccgttaagtattttgagtgtcccggtggcatagatatatgcagccaggataaagtttttggttatgtacagcagggtagttttaataaggctactgttgctcaaattaaagccttgtttttggataaagtggacatcttgctaactgttgatggtgtcaatttcactaacaggtttgtgcctgtaggtgaaaattttggtaagagtctaggaaatgtgttctgtgatggagttaatgtcacgaaacataagtgtgatataaattataaaggtaaagtctttttccagtttgataatctttctagtgaagatttaaaggctgtaagaagttcttttaattttgatcagaaggaattgcttgcctactacaacatgcttgttaattgttctaaatggcaggttgtttttaatggtaagtatttcacttttaagcaagctaataacaattgttttgttaatgtttcttgcttaatgctccagagtttgaatctgaaatttaaaattgttcaatggcaggaggcgtggcttgaatttcgttctggtcgccctgctagatttgtatctttggttttggccaaaggtgggtttaaatttggtgatcctgctgattctagagatttcttgcgtgttgtgtttagtcaagttgatttgacaggggcaatatgtgattttgaaattgcatgtaaatgtggtgtaaagcaggaacagcgtactggtgttgacgctgttatgcattttggtacattgagtcgtgaagatcttgagattggttacaccgtggattgttcttgtggtaaaaagctaatccattgtgtacgatttgatgtaccatttttaatttgtagtaatacacctgctagtgtaaaattacctaagggtgtaggaagtgcaaatatttttaaaggtgataaggttggtcattatgttcatgttaagtgtgaacagtcttatcagctttatgatgcttctaatgttaagaaggttacagacgttactggcaatttgtcagattgtttgtatcttaaaaatttgaaacaaacttttaaatcggtgttaaccacctattatttggatgatgttaagaaaattgagtataaacctgacttgtcacaatattattgtgacggaggtaagtattatactcagcgtattattaaagcccaatttaaaacatttgagaaagtagatggtgtgtatactaattttaaattgataggacacaccatctgtgatattcttaatgctaagttgggttttgatagctctaaagagtttgttgaatataaagttactgagtggccaacagctacaggtgatgtggtgttggctactgatgatttgtatgttaagagatatgaaaggggttgtattacttttggtaaacctgttatatggttaagccatgagcaagcttccctcaattctttaacatattttaatagacctttattggttgatgagaataaatttgatgttttaaaagtggatgatgttgacgatggtggtgatatctcagagagtgatgccaaagaatccaaagaaatcaacattattaagttaagtggtgttaaaaaaccatttaaggttgaagatagtgtcattgttaatgatgatactagtgaaatcaaatatgttaagagtttgtctatagttgatgtgtatgatatgtggcttacaggttgtaggtatgttgttagaactgctaatgatttgagcatggcagttaacgtacctacaatacgtaagtttataaaatttggtatgactcttgttagtataccaattgatttgttaaatttaagagagattaagcctgtttttaatgtggttaaagctgtgcgaaataaaatttctgcatgctttaattttattaaatggctttttgtcttattatttggctggatcaaaatatccgctgataataaagtaatttacaccacagaagttgcatcaaagcttacatgtaagcttgtagctttagcttttaaaaatgcgtttttgacatttaagtggagtgtggttgctagaggtgcttgcattatagcgactatatttctattgtggtttaattttatatatgccaatgtaatttttagtgatttttatttgcctaaaattggtttcttgccgacttttgttggtaagatcgcacagtggattaagagcacttttagtcttgtaactatttgtgatctatattccattcaggatgtgggttttaagaatcagtattgtaatggaagtatcgcatgtcaattctgcttggcaggatttgatatgttagataattataaagccattgatgtagtacagtatgaagctgataggagagcatttgttgattatacaggtgtgttaaagattgtcattgaattgatagttagttacgccctgtatacggcatggttttacccattgtttgctcttattagtattcagatcttgaccacttggctgcctgagctttttatgcttagtacattacattggagtgttaggttgctggtgtctttagctaatatgttaccagcacatgtgtttatgaggttttatattattattgcctcttttattaagctgtttagcttgtttaggcatgttgcctatggttgtagtaaacctggttgtttgttttgttacaagaggaatcgtagtctacgtgttaaatgtagtactattgttggtggcatgatacgctattacgatgttatggctaatggtggcactggcttttgttcaaaacatcaatggaattgcattgattgtgattcttataaaccaggtaatacttttattactgttgaggccgctcttgatttatctaaggaattgaaacggcctattcagcctacagatgttgcttatcatacggttacggatgttaagcaagttggttgttatatgcgcttgttctatgagcgtgatggacagcgcacatatgatgatgttaatgctagtttgtttgtggattatagtaatttgctacattctaaggttaagggtgtgcctaatatgcatgttgtggtagtggaaaatgatgccgataaagctaattttcttaatgctgctgtattttatgcacagtctttgtttagacctattttaatggttgataaaaatctgataactactgctaatactggtacgtctgttacagaaactatgtttgatgtttatgtggacacatttttgtctatgtttgatgtggataaaaagagtcttaatgctttaatagcaactgcgcattcttctataaaacagggtacgcagatttgtaaagttttggatacctttttaagctgtgctcgtaaaagttgttctattgattcagatgttgatactaagtgtttagctgattctgtcatgtctgctgtatcggcaggccttgaattgacggatgaaagttgtaataacttggtgccaacatatttgaagggtgataacattgtggcagctgatttaggtgttctgattcaaaattctgctaagcatgtgcagggtaatgttgctaaaatagccggtgtttcctgtatatggtctgtggatgcttttaatcagctaagttctgatttccagcataaattgaagaaagcatgttgtaaaactggtttgaaattgaagcttacttataataagcagatggctaatgtctctgttttaactacaccctttagtcttaaagggggtgcagtttttagttattttgtttatgtatgttttctgttgagtttggtttgttttattggattgtggtgcttaatgcccacttacacagtacacaaatcagattttcagcttcccgtttataccagttataaagttttagataatggtgttattagagatgttagcgttgaagatgtttgtttcgctaacaaatttgaacaatttgatcaatggtatgagtctacatttggtctaagttattatagtaacagtatggcttgtcccattgttgttgctgtagtagaccaggatcttggctctactgtgtttaatgtccctaccaaagtgttacgatatggttaccatgtgttgcactttattacacatgcactttctgctgatggagtgcagtgttatacgccacatagtcaaatatcgtattctaatttttatgctagtggctgtgtgctttcctccgcttgtactatgtttgcaatggccgatggtagtccacaaccttattgttatacagaggggcttatgcagaatgcttctctgtatagttcattggtacctcacgtgcggtataatcttgctaatgctaaaggttttatccgttttccagaagtgttgcgagaaggacttgtgcgtattgtgcgtactcgttctatgtcgtattgcagagttggattatgtgaggaagctgatgagggtatatgctttaactttaatggttcttgggtgcttaataatgattattatagatcattgcctgggaccttttgtggtagagatgtttttgacttaatttatcagctttttaaaggtttagcacagcctgtggatttcttggcattgactgctagttctattgctggtgctatacttgctgtaattgttgttttggtgttttattacttaataaagcttaaacgtgcttttggtgattacaccagtattgtttttgtcaatgtgattgtgtggtgtgtaaattttatgatgctttttgtgtttcaagtttaccctacactttcttgtgtatatgctatttgttatttttatgccacgctttatttcccttcggagataagtgtgataatgcatttacaatggctagttatgtatggcactattatgcctttatggttttgtttgctatatatatctgttgttgtttcaaatcatgctttttgggtattcgcttactgcagacggcttggtacttctgttcgtagtgatggtacatttgaagaaatggctcttactacttttatgattacaaaagattcttattgtaagcttaagaattctttgtctgatgttgcttttaatagatatttgagtttgtataataaatataggtattacagcggtaaaatggatactgctgcatatagggaggctgcttgttctcagttggctaaagcaatggatacatttaccaataataatggtagtgatgtgctttaccaaccacctactgcttccgtttcaacttcattcttgcaatctggtattgtgaaaatggttaatcctacttctaaggtagaaccatgtattgtcagtgttacctatggtaatatgacattgaatggtttatggttggatgataaggtctactgtcccagacatgtgatatgttctgcttcagatatgactaatccagattatacaaatttgttgtgtagagtaacatcaagtgattttactgtattgtttgatcgtttaagccttacagtgatgtcttatcaaatgcagggttgtatgcttgttcttacagtgaccctgcaaaattctcgtacgccaaaatatacatttggtgtggttaaacctggtgagacttttactgttttagctgcttataacggcaaaccacaaggagcctttcatgtgactatgcgtagtagttataccattaagggttcctttttgtgcgggtcttgtggatctgttggttatgtgctaatgggtgattgtgttaaatttgtgtatatgcatcaattggagcttagtactggttgtcatactggtactgatttcaatggggatttttatggtccttataaggatgctcaggttgtccaattgcccgttcaggattatatacaatctgttaattttgtagcatggctttatgctgctatacttaataattgtaattggtttgtacaaagtgataagtgttctgttgaagattttaatgtgtgggctttgtctaatgggtttagccaagttaagtctgatcttgttatagatgctttagcttctatgactggtgtgtctttggaaacactattggctgctattaagcgtctcaagaatggttttcaaggacgtcagattatgggtagttgctcctttgaggatgaattgacacctagcgatgtttatcaacaactcgctggtatcaagttacaatcaaagcgtactagattggttaaaggcattgtttgttggattatggcttctacatttttgtttagttgtataattacagcatttgtgaaatggactatgtttatgtatgtaactactaatatgcttagtattacgttttgtgcactttgtgttataagtttggccatgttgttggttaaacataagcatctttatttgactatgtatataattcctgtgctttttacactgctgtataacaactatttggttgtgtacaagcagacatttagaggctatgtttatgcatggctatcatattatgttccatcagttgagtatacttatactgatgaagttatttatggcatgttattgcttataggaatggtctttgttacattacgtagcattaaccatgatttgttctcttttataatgtttgttggccgtgtgatttctgttgtctctttgtggtacatgggttctaacttagaggaagaaattcttcttatgttggcttctctttttggtacttacacatggacaacagctttatctatggctgcagcaaaggttattgctaagtgggttgctgtgaatgttttgtatttcacagatatacctcaaattaagatagtgcttgtatgctatttgtttataggttatattattagctgttattggggtttgttttccttgatgaacagtttgtttagaatgcctttgggtgtttataattataaaatttcagtacaggaattaagatatatgaatgctaatggattgcgccctcctaagaatagttttgaagcccttatgcttaattttaagcttttgggtattggaggtgtgccaattattgaagtatctcaatttcaatcaaaattgactgatgttaaatgtgctaatgttgtcttgcttaattgcttgcaacatttgcatgttgcttctaactctaagttgtggcagtattgtagcactttgcacaatgaaatacttgccacttctgatctgggtgttgcttttgaaaagcttgctcagttgttaattgttttgtttgctaatccagctgctgtggatagcaagtgcctgactagtattgaagaagtttgcgacgattacgcaaaggacaatactgttttgcaggctttacagagtgaatttgttaatatggctagcttcgttgaatatgaagttgctaagaaaaatcttgatgaggcgcgttctagtggttctgctaatcaacagcagttaaaacagctagagaaagcctgtaatattgctaaatctgcttatgaacgcgaccgtgctgtagcaagaaagttggagcgtatggcagatttggctctcactaatatgtataaagaagctagaattaatgataagaagagtaaggttgtttctgccttgcaaactatgctttttagtatggtgcgtaagttagataatcaagctctgaattcaatattagataatgctgtgaagggttgtgtaccattgaatgcaatcccttcattggctgcaaatactctgactataattgtaccagataaaagtgtttacgatcaggtagttgacaatgtctatgttacctatgcgggtaatgtatggcagattcaaactatccaagattcagatggtacaaataagcagttgaatgagatatctgatgattgtaactggccactagttattattgcaaatcggcataatgaggtatctgcaaccgttttgcaaaataatgaattaatgcctgctaagttgaaaactcaggtcgttaatagtggtccagatcagacttgtaacacacctactcaatgttactataataatagtaacaatgggaagattgtttatgctatacttagtgatgttgatggtcttaagtatacaaagattcttaaagatgatggcaattttgttgttttggagttagatcctccttgtaaatttactgttcaagatgttaaaggtcttaaaattaagtacctttattttgtaaaaggttgtaacacactagcaagaggctgggttgttggtacaatttcttctacagttagattgcaagctggaactgctactgagtatgcttccaactcatctatattatctttatgtgcgttttctgtagatcctaagaaaacgtatttagattttatacagcagggaggaacacctattgccaattgtgttaaaatgttgtgtgaccatgctggtaccggtatggccattactgttaaacccgatgctaccactaatcaggattcatatggtggtgcgtctgtttgtatatattgccgcgcacgagttgaacacccagatgttgatgggttgtgcaaattacgcggcaagtttgtacaagtgcctgtaggtataaaagatcctgtgtcttatgttttgacacatgatgtttgtcaagtttgtggattttggcgggatggaagttgttcatgtgttagcactgacactactgttcagtcaaaagatactaattttttaaacgggttcggggtacgagtgtagatgcccgtctcgtaccctgtgccagtggtttatctactgatgtacaattaagggcatttgatatttgcaatgctagtgttgctggcattggtttacatttaaaagttaattgctgccgttttcagcgtgttgatgagaacggtgataaattagatcagttctttgttgttaagaggacagatctgactatatataatagagagatggaatgctatgagcgtgtaaaagattgtaagtttgtggctgaacacgatttctttacatttgatgtagaaggtagtcgtgtgccacatattgtacgcaaggatttaacaaagtatactatgttggatctttgctatgcgttgcgacattttgatcgcaatgattgcatgctgctttgtgacattctctctatatatgctggttgtgaacaatcctactttactaagaaggattggtatgattttgttgaaaatcctgatattattaatgtttataaaaagctaggacctatttttaatagagccctagttagcgctactgagtttgcagacaaattggtggaggtaggcttagtaggcattttaacacttgataaccaagatttaaatggtaaatggtatgattttggtgactatgttattgcagccccaggttgtggtgttgctatagcagactcttattattcttatatgatgcctatgctgaccatgtgtcatgcattggattgtgaattgtatgtgaataatgcttatagactatttgatcttgtacagtatgattttactgattacaagctcgaattgtttaataagtattttaagcactggagtatgccataccatcctaacacggttgattgtcaggatgatcggtgtatcatacattgtgctaattttaacatactttttagtatggttttacctaatacatgttttgggcctcttgttaggcaaatttttgtggatggtgttccttttgttgtttcaattggataccattataaagaacttggtattgtgatgaatatggatgtggatacacatcgttatcgcttgtctttaaaagacttgcttttatatgctgctgatccagctttgcatgtagcttctgctagtgcattgtatgatttacgcacttgctgttttagtgttgcggctataacaagcggtgtgaaatttcaaacagttaaacctggtaattttaatcaggatttttatgattttattttaagtaagggcctgcttaaagagggtagttcagttgatctgaagcactttttctttacgcaggatggtaatgctgctattactgattataattattataagtataatttgcccaccatggtggacattaagcagttgttgtttgttttggaagttgtttataagtattttgagatttatgatggtgggtgtataccggcatcacaagtcattgttaataattatgataagagtgctggctatccatttaataaatttggaaaagccaggctctattatgaagcattatcatttgaggagcaggatgaaatttacgcctatactaagcgcaatgtcctgccaacacttactcaaatgaatttgaaatatgctattagtgctaagaatagagcccgcactgttgctggtgtttccatacttagtactatgactggcagaatgtttcatcaaaagtgtttgaaaagtatagcagctacacgtggtgttcctgttgttataggcaccactaaattttatggcggctgggatgatatgttacgtcgccttattaaagatgttgataatcctgtacttatgggttgggattatcctaagtgtgatcgtgctatgccaaacatactacgtattgttagtagtctggttttggctcgaaaacatgaggcatgttgttcgcaaagcgataggttttatcgacttgcgaatgaatgcgcacaagttctgagtgaaattgttatgtgtggtggctgttattatgttaagcctggtggcactagtagtggtgatgcaactactgcttttgctaattcagtttttaacatatgtcaagctgtttcagccaatgtatgtgctttaatgtcatgcaatggtaataagattgaagatttgagtatacgtgctcttcagaagcgcttatactcacatgtgtatagaagtgatatggttgattcaacctttgtcacagaatattatgaatttttaaataagcattttagtatgatgattttgagtgatgatggcgttgtgtgttataattctgattatgcgtccaaagggtatattgctaatataagtgcctttcaacaggtattgtattatcaaaataacgtttttatgtcagaatccaaatgttgggttgaaaatgacataaacaatggacctcatgaattctgttcacaacacacaatgcttgtaaagatggatggggacgatgtctatcttccatatcctgatcctagtcgtatattaggagctggatgttttgtagatgatttgttaaagactgatagtgttcttttaatagaacgatttgtaagtcttgcaatagatgcttatccacttgtgtaccacgaaaatgaagaataccaaaaggtttttcgtgtttatttggagtatataaagaagttgtacaatgacctgggtaatcagatcttggatagctacagtgttattttaagtacttgtgatggacaaaagtttactgatgagtccttttacaagaacatgtatttaagaagtgcagttatgcagagtgttggagcttgcgtggtctgctcttctcaaacatcattacgttgtggcagttgcatcagaaagcctcttctttgctgcaagtgttgttacgatcatgttatggcaactgatcataaatatgttttgagtgtttcaccatatgtgtgtaacgcaccaggatgtgatgtaaatgatgttaccaaattgtatctaggtggtatgtcatattattgtgaagatcataagccacaatattcgtttaagttggtaatgaatggtatggtttttggtctatataaacaatcttgtacaggatctccgtacatagatgattttaatcgtatagctagttgtaaatggactgatgttgatgattacatactggctaatgaatgtacagagcgcttgaaattgtttgctgcagaaacgcaaaaggcgactgaggaagcctttaagcagagttatgcatcagcaacaatacaagagattgttagcgagcgcgaattgatcctttcttgggagattggaaaagtgaagccaccacttaataaaaattatgtttttactggctaccattttactaaaaatggcaagacagttttaggtgagtatgtttttgataagagtgagttgactaatggtgtgtattatcgcgccacaaccacttataagctatctgtaggagatgtttttgttttaacctctcattcagtagctaatttaagtgctcctacgcttgtgccgcaggagaattatagtagtattagatttgctagtgtttatagtgtgcttgagacgtttcagaacaatgtcgttaattatcaacacattggtatgaaacgttattgtaccgtgcaaggacctcctggtacaggaaagtcacatcttgctattggtcttgctgtttattattgtacagcacgtgtagtatacactgcggccagccatgcagctgttgacgcattgtgtgaaaaagcatacaaatttttgaatataaatgactgcactcgtattgttcctgccaaggtcagggtggagtgctatgataagtttaaaattaatgacaccactcgtaagtatgtgtttactactataaatgcattacctgagatggtgactgatattgttgttgtagatgaagttagtatgcttaccaattatgagctttctgttattaatgctcgtattcgtgctaagcattatgtttacattggtgatcctgctcaattgccagcaccacgtgtgttattgagcaagggtacacttgaacctaaatattttaacactgttactaagcttatgtgttgcttagggccagacatttttcttggtacatgttatagatgtcctaaggaaattgttgatacagtgtctgccttggtttatgaaaataagcttaaggctaagaatgaaagtagttcattgtgttttaaggtctattataaaggcgttacaacacatgaaagttctagtgctgtaaatatgcagcagatttatttgattaataagtttttgaaggctaaccctttgtggcataaagccgtttttattagcccatataatagccagaactttgcagctaagcgtgttttgggtttgcaaacccagaccgtggattctgctcaaggttctgaatatgattatgttatatattcacagactgcagaaacagcgcattctgtaaatgttaatcgcttcaatgttgctattactcgagccaagaaaggtattctttgtgttatgagtaatatgcagttgtttgaagcattacagtttactacattgaccttagataaagtgccacaggccgttgaaacgagagttcaatgtagtaccaatttatttaaagattgtagcaagagttatagtggttaccacccagctcacgctccttcatttttggcagtagatgacaaatataaggcaactggcgatttagccgtgtgtcttggtattggagattctgctgttacatattcaagattaatatcactcatgggttttaaacttgatgtcacccttgatgggtattgtaagctttttataactaaagaagaagctgttaaacgcgtgcgtgcttgggttggctttgatgctgaaggcgctcatgccacgcgtgatagcattgggacaaatttcccacttcaattagggttttctacaggaattgattttgttgtggaagccactggtttgtttgctgatagagatggttacagctttaaaaaggctgtggctaaagctcctcctggtgaacaatttaagcatctcatccctttgatgactagaggtcagcgctgggatgttgttagacctagaatagtacaaatgtttgcagatcatttaattgatctgtctgattgtgttgtgctagttacatgggcagccaactttgagctcacttgtctccgatactttgcaaaagtaggtcgtgagatttcttgtaatgtgtgcactaaacgtgccacagcttacaattctagaactggttactatggttgttggcgccatagtgttacatgtgattacttgtataatccacttattgttgatattcaacagtggggatatattggatctttatcaagtaatcatgatttatattgtagtgtccacaaaggagcacatgttgcttcatctgatgctataatgacacggtgtttggccgtttatgattgtttttgcaataatattaattggaatgtggagtatcccattatttcaaatgagttaagtattaatacctcttgtagggtcttgcagcgtgttatgcttaaagctgcaatgctctgcaacagatatactttgtgttatgatattggcaacccaaaagcgattgcctgtgtcaaagattttgattttaagttctatgatgcccaaccaattgttaagtctgtcaagactcttttgtattcttttgaggcacataaggactcttttaaagatggtttgtgtatgttttggaactgtaatgtggataagtatccaccgaatgcagttgtatgtagatttgacacgagagtgttgaataatttaaatcttcctggctgtaatggaggtagtttgtatgttaataaacatgcattccacactaaacccttttctagggcagcctttgagcatttgaagcctatgccatttttctattattcagatacgccttgcgtgtatatggatggcatggatgctaagcaggttgattatgtacctttgaaatccgccacttgcatcacaagatgcaatttaggtggtgcagtttgtttaaaacatgctgaagagtatcgtgagtacctagagtcttacaatacagctactacagcaggttttactttttgggtctataagacatttgatttttataatttgtggaatacgttcaccaagctacaaagcttggagaacgttgtatataatttagtcaaaactggtcattatacaggacaggctggtgaaatgccttgtgccattataaatgataaagttgtggctaagatcgataaggaggatgttgtcatttttattaataatacaacataccctactaatgttgctgttgaattatttgccaagcgcagtattcgacaccatccagagcttaagctctttagaaatttgaatatagacgtgtgttggaagcacgtcatttgggattatgctagagaaagtatattttgcagtaatacctatggtgtctgcatgtatacagatttaaagttcattgataaattgaatgtcctttttgatggtcgtgataatggtgctcttgaagcttttaaacgctctaataatggcgtttacatttccacgacaaaagttaagagtctttcgatgataaaaggtccaccgcgtgctgaattaaatggcgtagtggtggacaaggttggagacactgattgtgtgttttattttgctgtgcgtaaagagggtcaggatgtcatcttcagccaattcgacagcctgagagtcagctctaaccagagcccacaaggtaatctggggagtaatgaacccggtaatgtcggtggtaatgatgctctggcaacctccactatctttacacaaagccgtgttattagctcttttacatgtcgtactgatatggaaaaagattttatagctttagatcaagacttgtttattcagaagtatggtttggaggactatgcctttgaacacattgtttatggtaatttcaaccagaagattattggtggtttgcatttgttaataggcttgtaccgaagacagcaaacttccaatctggttattcaggagtttgtttcatacgactccagcatacactcttattttatcactgatgagaagagtggtggtagtaagagtgtttgcactgttatagatattttgttggatgattttgtggctcttgttaagtcacttaatctcaactgtgtgagtaaggttgttaacgttaatgttgattttaaagattttcagttcatgctttggtgtaacgatgagaaagttatgactttctatcctcgtttgcaagctgcatctgactggaagcctggttattctatgcctgtattatacaagtatttgaattccccaatggaaagagttagtctctggaattatgggaagccggttactttgcctacaggctgtatgatgaatgttgctaagtatactcagttatgtcaatatctgaatactacaacattagctgtacctgttaatatgcgagttttgcatttaggtgcaggttcagaaaaaggagtagcaccgggttctgcagttcttaggcagtggttgcctgctggtactattcttgtagataatgatttatacccatttgtgagtgacagtgtcgctacatattttggggattgtataaccttaccctttgattgtcaatgggatttgataatttctgatatgtatgaccctattactaagaacataggggagtacaatgtaagtaaagatggtttctttacatacatttgtcatatgattcgcgacaagttagctctgggtggcagtgttgctataaaaataacagagttttcttggaatgcagaattatataagttaatggggtattttgcattttggacggttttctgcacaaatgcaaacgcttcttctagtgaagggtttttaattggcataaattatttgggtaagcccaaggttgagatagatggaaatgttatgcatgccaattatttgttttggagaaattccacagtttggaacgggggtgcttatagcctgtttgacatggctaaattcccgcttaagttggctggtactgccgtaataaatttaagagcagaccagattaatgatatggtttattcccttcttgaaaagggtaaactacttgttagagatacaaataaagaagtttttgttggtgacagtttggttaatgtaatctaaactttaagaatggcagtcgcttatgcagacaagcctaatcactttatcaattttccacttacccagtttcagggctttgtgttaaattataaaggtttacaatttcaacttctcgatgaaggagtggattgtaaaatacaaacagcgcctcacattagtcttgctatgctggatattcagcctgaagactacagaagtgttgatgttgctattcaagaagttattgatgatatgcattggggtgagggctttcagattaaatttgaaaacccccatatcctaggaagatgcatagttttagatgttaaaggtgtagaagaattgcatgatgatttagttaattacattcgtgataagggttgtgttgatgaccaatccaggaagtggattggacattgcaccatagcccaactcactgatgctgcactttccattaagggaaatgttgattttataaacagcatgcaattcaactataaaatcactatcaatccctcatcaccggctagacttgaaatagttaagcttggtgctgaaaagaaagatggtttttatgaaaccatagctagccactggatgggaattcgttttgaatataatccacccactgataagctagctatgattatgggttattgttgtttagaagtggtgcgtaaagagctagaagaaggtgaccttcccgagaatgatgatgatgcttggtttaagctatcgtaccattatgaaaacaattcttggttctttcgacatgtctacaggaaaagttcttatttccgtaagtcttgtcaaaatttagattgtaattgtttggggttttatgaatcttcagttgaagaagactaaactcagtgaaaatgtttttgcttcctagatttgttctagttagctgcataattggtagcctaggttttgacaaccctcctaccaatgttgtttcgcatttaaatggagattggtttttatttggtgacagtcgttcagattgtaatcatgttgttactaccaacccccgtaattattcttatatggaccttaatcctgccttgtgtggttctggtaaaatatcagctaaagctggcaactccatttttaggagttttcactttactgatttttataattacacaggcgaaggtcaacaaattattttctatgagggtgttaattttacgccttatcatgcctttaaatgcatcacttctggtagtaatgatatttggatgcagaataaaggcttgttttacactcaggtttataagaatatggctgtgtatcgcagccttacttttgttaatgtaccatatgtttataatggctctgcacaatctacagccctttgtaaatctggtagtttagttcttaataaccctgcatatatagctcgtgaagctaattttggggattattattataaggttgaagctgatttttatttgtcaggttgtgacgagtatatcgtaccactttgtattttcaacggcaagtttttgtcgaatacaaagtattatgatgatagtcaatattattttaataaagacactggtgttatttatggtctcaattctactgaaaccattaccactggttttgactttaattgtcattatttagttctaccctctggtaattatttagccatttcaaatgagctattgttaactgttcctactaaagcaatctgtcttaataagcgtaaggattttacgcctgtacaggttgttgattcgcggtggaacaatgccaggcagtctgataacatgacggcagttgcttgtcaacccccgtactgttattttcgtaattctactaccaattatgttggtgtttatgatatcaatcatggggatgctggttttactagcatactcagtggtttgttatatgactcaccttgtttttcgcagcaaggtgtttttaggtatgataatgttagcagtgtctggcctctctacccttatggcagatgccctactgctgctgatattaatacccctgatgtacctatttgtgtgtatgatccgctaccaattattttgcttggcattcttttgggtgttgcggtcataattattgtagttttgttgttatattttatggtggataatggtactaggctgcatgatgcttagaccataatctaaacatgtttttgatacttttaatttccttaccaacggcttttgctgttataggagatttaaagtgtactacagtttccattaatgatgttgacactggtgttccttctattagcactgatactgtcgatgttactaaaggtttaggtacttattatgttttagatcgtgtgtatttaaatactacgttgttgcttaatggttattaccctacttcaggttctacatatcgtaatatggcactgaagggaactttactattgagcacactgtggtttaaaccaccttttctttctgattttactaatggtatttttgctaaggtcaaaaataccaaggttattaaagatggtgtaatgtatagtgagtttcctgctataactataggtagtacttttgtaaatacatcctatagtgtggtagtacaaccacatactaccattttgggtaataaattacaaggtttcttagagatctctgtttgccagtatactatgtgcgagtacccaaatacgatttgtaatcctaatctgggtaatcgacgcgtagaactatggcattgggatacaggtgttgtttcctgtttatataagcgtaatttcacatatgatgtgaatgctgattatttgtatttccatttttatcaagaaggtggtactttttatgcatattttacagacactggtgtcgttactaagtttctgtttaatgtttatttaggcacggtgctctcacattattatgtcatgcctttgacttgtaatagtgctctgactttagaatattgggttacacccctcacttctaaacaatatctactagctttcaatcaagatggtgttatttttaatgctgttgattgtaagagtgattttatgagtgagattaagtgtaaaacactatctatagcaccatctactggtgtttatgaattaaacggttacactgttcagccaattgcagatgtttaccgacgtatacctaatcttcccgattgcaatattgaggcttggcttaatgataagtcggtgccctctccattaaattgggaacgtaagactttttcaaattgtaattttaatatgagcagcctgatgtcttttattcaggcagactcatttacttgtaataatattgatgctgctaagatatatggtatgtgtttttccagcataactatagataagtttgcaatacccaatggtaggaaggttgacctacaattgggtaatttgggttatttgcagtcttttaactatagaattgatactactgctacaagttgtcagttgtattataatttacctgctgctaatgtttctgttagcaggtttaatccttctacttggaataggagatttggttttacagaacaatctgtttttaagcctcaacctgcaggtgtttttactgatcatgatgttgtttatgcacaacattgttttaaagctcccacaaatttctgtccgtgtaaattggatgggtctttgtgtgtaggtaatggtcctggtatagatgctggttataaaactagtggcataggcacttgtcctgcaggtactaattatttaacttgccataatgctgcccaatgtgattgtttgtgcactccagaccccattacatctaaagctacagggccttacaagtgcccccaaactaaatatttagttggcataggtgagcactgttcgggtcttgctattaaaagtgatcattgtggaggtaacccttgtacttgccaaccacaagcatttttggggtggtctgttgactcttgtttacaaggggataggtgtaatatttttgctaatttcattttgcatgatgttaatagtggtactacttgttctactgatttacaaaaatcaaacacagacataattcttggtgtttgtgttaattatgatctttatggtattactggccaaggtatctttgttgaggttaatgcgacttattataatagttggcagaaccttttatatgattctaatggtaatctctatggttttagagactacttaacaaatagaacttttatgattcgtagttgctatagtggtcgtgtttcagcggcctttcatgctaactcttccgaaccagcattgctatttcggaatattaaatgcaattacgtttttaataatactctttcacgacagctgcaacctattaactattttgatagctatcttggttgtgttgtcaatgctgataatagtacttctagtgttgttcaaacatgtgatctcacagtaggtagtggttactgtgtggattactctacaaaaagacgaagtcgtagatcgattaccactggttatcggtttactaattttgagccatttactgttaattcagtaaatgatagcttagaacctgtaggtggtttgtacgaaattcaaataccttcagagtttactataggtaatatggaggagtttattcaaacaagctctcctaaagttactattgattgttctgcttttgtctgtggtgattatgcagcatgtaaatcacagttggttgaatatggtagcttctgtgacaatattaatgctatactcacagaagtaaatgaactacttgacactacacagttgcaagtagctaatagtttaatgaatggtgtcactcttagcactaagcttaaagatggcgttaatttcaatgtagacgacatcaatttttcccctgtattaggttgtttaggaagcgattgtaataaagtttccagtagatctgctatagaggacttacttttttctaaagtaaagttatctgatgtcggtttcgttgaggcttataataattgtactggaggtgccgaaattagggacctcatttgtgtgcaaagttataatggtatcaaggtgttgcctccactgctctcagaaaatcagatcagtggatacactttggctgccacctctgctagcctgtttcctccatggtcagcagcagcaggtgtaccattctatttaaatgttcagtatcgtattaatggtattggtgttaccatggatgtgctaagtcaaaatcaaaagcttattgctaatgcatttaacaatgctcttggtgctattcaggaagggtttgatgctaccaattctgctttagttaaaattcaagctgttgttaatgcaaatgctgaaactcttaataacttattgcaacaactctctaatagatttggtgctataagttcttctttacaagaaattctatctagactggatgctcttgaagcgcaagctcagatagacagacttattaatgggcgtcttaccgctcttaatgcttatgtttctcaacagcttagtgactctacactagtaaagtttagtgcagcacaagctatggagaaggttaatgaatgtgtcaaaagccaatcatctaggataaatttttgtggtaatggtaatcatattatatcattagtgcagaatgctccatatggtttgtattttatccactttagctatgtccctactaagtatgtcactgcgaaggttagtcccggtctgtgcattgctggtggtagaggtatagcccctaagagtggttattttgttaatgtaaataacacttggatgttcactggtagtggttattactaccctgaacctataactggaaataatgttgttgttatgagtacctgtgctgttaattatactaaagcgccggatgtaatgctgaacatttcaacacccaacctccctgattttaaggaagagttggatcaatggtttaaaaaccaaacttcagtggcaccagatttgtcacttgattatataaatgttacattcttggacctacaagatgaaatgaataggttacaggaggcaataaaagttttaaatcagagctacatcaatctcaaggacattggtacatatgagtattatgtaaaatggccttggtatgtatggcttttaattggctttgctggtgtagctatgcttgttttactattcttcatatgctgttgtacaggatgtgggactagttgttttaagaaatgtggtggttgttgtgatgattatactggacaccaggagttagtaattaaaacatcacatgaagattaagttcgtctttgatttattgactcctgacgatatattacatccctccaatcatgtgaatctaattataagacccatttaggtcgagcatattataatagctaccacaatgcctgctgtttagtgggtactgtgtcttatataactagtaaacctgcaatgccaatggctacaaccattgaaggtgcagattatactaacattatgcctattactgttcttacaacagtttatttaggcgtttctataggtattgacactagcaccactggttttacctgtttttcacgttactagttccaaaccatattataattcaggtagaccttataactttaagcattattgccaaagtttttaaggccacgccttagtaatggacatctggaaacctgagattaaatatctccgttatactaacggttttaatgtctcagaattagaagatgcttgttttaaatttaactataaatttcctaaagtaggatattgtagagttcctagtcatgcttggtgccgtaatcaaggtagcttttgtgctacactcactctttatggcaaatccaaacattatgataaatattttggagtaataactggttttacagcattcgctaatactgtagaggaggctgtcaacaaactggttttcttagctgttgactttattacctggcgtagacaggagttaaatgttcatggctgatgcttattttgcagacactgtgtggtatgtggggcaaataatttttatagttgccatttgtttattggttataatagttgtagtggcatttttggcaacttttaaattgtgtattcaactttgcggtatgtgtaataccttagtactgtccccttctatttatgtgtttaatagaggtaggcagttttatgagttttacaatgatgtaaaaccaccagttcttgatgtggatgacgtttagttaatccaaacattatgagtagtgtaactacaccagcacctgtttacacctggactgctgatgaagctattaaattcctaaaggaatggaacttttctttgggtattatactactttttattacagtcatattgcaatttggatatacaagtcgcagtatgtttgtttatgttattaagatgatcattttgtggcttatgtggccccttactatcatcttaactattttcaattgcgtgtatgcgttgaataatgtgtatcttggcttctctatagtttttactatagtggccattatcatgtggattgtgtattttgtgaatagtatcaggttgtttattagaactggaagttggtggagtttcaacccagaaacaaacaacttgatgtgtatagatatgaaaggaaggatgtatgttaggccgataattgaggactaccatacccttacggtcacaataatacgtggtcatctttacatgcaaggtataaaactaggtactggctattctttgtcagatttgccagcttatgtgactgttgctaaggtctcgcacctgctcacgtataagcgtggttttcttgacaagataggcgatactagtggttttgctgtttatgttaagtccaaagtcggtaattaccgactgccatcaacccaaaagggttctggcttggacaccgcattgttgagaaataatatctaaactttaaggatgtcttttactcctggtaagcaatccagtagtagagcgtcctctggaaatcgttctggtaatggcatccttaagtgggccgatcagtccgatcaatctagaaatgttcaaaccaggggtagaagagctcaatccaagcaaactgctacttctcagcaaccatcaggagggaatgttgtaccctactattcttggttctctggaattactcagtttcaaaagggaaaggagtttgaatttgcagagggacaaggtgtgcctattgcaccaggagtcccagctactgaagctaaggggtactggtacagacacaacagacgttcctttaaaacagccgatggcaaccagcgtcaattgctgccacgatggtatttttactatcttggaacaggaccgcatgccaaagaccagtatggcaccgacattgacggagtctactgggtcgctagtaaccaggctgatgtcaataccccggctgacattctcgatcgggacccaagtagcgatgaggctattccgactaggtttccgcctggcacggtactccctcagggttactatattgaaggctcaggaaggtctgctcctaattccagatctacttcacgcgcatccagtagagcctctagtgcaggatcgcgcagtagagccaattctggcaatagaacccctacctctggtgtaacacctgatatggctgatcaaattgctagtcttgttctggcaaaacttggcaaggatgccgctaagccacagcaagtaactaagcagactgccaaagaaatcagacagaaaattttgaataagccccgccagaagaggagccccaataaacaatgcactgttcagcagtgttttgggaagagaggccccaatcagaattttggtggtggagaaatgttaaaacttggaactagtgatccacagttccccattcttgcagaactcgcacccacagctggtgcgtttttctttggatcaagattagagttggccaaagtgcagaatttgtctgggaatcttgacgaaccccagaaggatgtttatgaattgcgctataatggcgcaattagatttgatagtacactttcaggttttgagaccataatgaaggtgttgaatgagaatttgaatgcataccaacaacaggatggtacgatgaatatgagtccaaaaccacagcgtcagcgtggtcagaagaacggacaaggagaaaatgataatataagtgttgcagcgcccaaaagccgtgtgcagcaaaataagattagagagttgactgcagaggacatcagccttcttaagaagatggatgagccctttactgaagacacctcagaaatataagagaatgaaccttatgtcggcacctggtggtaacccctcgcaggaaagtcgggataaggcactctctatcagaatggatgtcttgctgctataatagatagagaaggttatagcagactatagattaattagttgaaagttttgtgtggtaatgtatagtgttggagaaagtgaaagacttgcggaagtaattgccgacaagtgcccaaggggaagagccagcatgttaagttaccacccagtaattagtaaatgaatgaagttaattatggccaattggaagaatcac

SEQ ID NO: 23 - DNA, 31032 bp, Coronavirus
gattgtgagcgatttgcgtgcgtgcatcccgcttcactgatctcttgttagatctttttataatctaaactttataaaaacatccactccctgtattctatgcttgtgggcgtagatttttcatagtggtgtctatattcatttctgctgttaacagctttcagccagggacgtgttgtatcctaggcagtggcccacccataggtcacaatgtcgaagatcaacaaatacggtctcgaactacactgggctccagaatttccatggatgtttgaggacgcagaggagaagttggataaccctagtagttcagaggtggatatagtatgctccaccactgcgcaaaagctggaaacaggcggaatttgtcctgaaaatcatgtgatggtggattgtcgccgacttcttaaacaagagtgttgtgtgcagtctagcctaatacgtgaaattgttatgaatacacgtccatatgatttggaggtgctacttcaagatgctttgcagtcccgcgaagcagttttggttacaccccctctaggtatgtctctggaggcatgctatgtgagaggttgtaatcctaatggatggaccatgggtttgtttcggcgtagaagtgtgtgtaacactggtcgttgcgctgttaacaagcatgtggcctatcagctatatatgattgatcctgcgggtgtctgttttggtgcaggtcaatttgtgggttgggttatacccttagcctttatgcctgtgcaatcccggaaatttattgttccttgggttatgtacttgcgtaagtgtggcgaaaagggtgcctacaataaagatcataaacgtggcggttttgaacacgtttataattttaaagttgaggatgcttacgacctggttcatgatgagcctaagggtaagttttctaagaaggcttatgctttaattagaggataccgtggtgttaaaccgcttctctatgtagaccagtatggttgtgattatactggtggtcttgcagatggcttagaggcttatgctgataagacattgcaagaaatgaaggcattatttcctatttggagccaggaactcccttttgatgtaactgtggcatggcacgttgtgcgtgatccacgttatgttatgagactgcagagtgcttctactatacgtagtgttgcatatgttgctaaccctactgaagacttgtgtgatggttctgttgttataaaggaacctgtgcatgtttatgcggatgactctattattttacgtcaacataatttagttgacattatgagttgtttttatatggaggcagatgcagttgtaaatgctttttatggtgttgatttgaaagattgtggttttgttatgcagtttggttatattgactgcgaacaagacttgtgtgattttaaaggttgggttcctggtaatatgatagatggttttgcttgcactacttgtggtcatgtttatgagacaggtgatttgctagcacaatcttcaggtgttttgcctgttaatcctgtattgcatactaagagtgcagcaggttatggtggttttggttgtaaggattcttttaccctgtatggccaaactgtagtttattttggaggttgtgtgtattggagtccagcacgtaatatatggattcctatattaaaatcttctgttaagtcttatgacggtttggtttatactggagttgtaggttgcaaggctattgtaaaggaaacaaatctcatttgcaaagcgttgtaccttgattatgttcaacacaagtgtggcaatttacaccagcgggagttgctaggtgtgtcagatgtgtggcataaacaattgttattaaatagaggtgtgtacaaacctcttttagagaatattgattattttaatatgcggcgcgctaaatttagtttagaaacttttactgtttgtgcagatggttttatgccttttcttttagatgatttggttccgcgcgcatattatttggcagtaagtggtcaagcattttgtgactacgcaggtaaaatctgccatgctgttgtgtctaagagtaaagagttacttgatgtgtctctggattctttaggtgcagctatacattatttgaattctaaaattgttgatttggctcaacattttagtgattttggaacaagtttcgtttctaaaattgttcatttctttaagacttttactactagcactgctcttgcatttgcatgggttttatttcatgttttgcatggtgcttatatagtagtggagagtgatatatattttgttaaaaacattcctcgttatgctagtgctgttgcacaagcatttcggagtgttgctaaagttgtactggactctttaagagttacttttattgatggcctttcttgttttaagattggacgtagaagaatttgtctttcaggcagtaaaatttatgaagttgagcgtggcttgttacattcatctcaattgccattagatgtttatgatttaaccatgcctagtcaagttcagaaaaccaagcaaaaacctatttatttaaaaggttctggttctgatttttcattagcggatagtgtagttgaagttgttacaacttcacttacaccatgtggttattctgaaccacctaaagttgcagataaaatttgcattgtggataatgtttatatggccaaggctggtgacaaatattaccctgttgtggttgatggtcatgttggacttttggatcaagcatggagggttccttgtgctggaaggtgtgttacatttaaggaacagcctacagtaaatgagattgcaagcacgcctaagactattaaagttttttatgagcttgacaaagattttaatactattttaaacactgcatgtggagtgtttgaagtggatgatactgtggatatggaggaattttatgctgtggtgattgatgccatagaagagaaactttctccatgtaaggagcttgaaggtgtaggtgctaaagttagtgcctttttacagaaattagaggataattccctatttttatttgatgaggctggtgaggaagttcttgctcctaaattgtattgtgcttttacagctcctgaagatgatgactttcttgaagaaagtggtgttgaagaagatgatgtagaaggtgaggaaactgatttaactgtcacaagtgctggagagccttgtgttgccagtgaacaggaggagtcttctgaaatcttagaggacactttggatgatggtccatgtgtggagacatctgattcacaagttgaagaagatgtacaaatgtcggattttgttgatcttgaatctgtgattcaggattatgaaaatgtttgttttgagttttatactacagaaccagaatttgttaaagttttggatctgtatgttcctaaagcaactcgcaacaattgctggttgcgatcagttttggcagtgatgcagaaactgccctgtcaatttaaagataaaaatttgcaggatctttgggtgttatataagcaacagtatagtcagttgtttgttgataccttggttaataagatacctgctaatattgtagttccacaaggtggttatgttgctgattttgcatattggttcttaaccttatgtgattggcagtgtgttgcatactggaaatgcattaaatgtgatttagctcttaagcttaaaggcttggatgctatgttcttttatggcgatgttgtctcacatgtgtgcaagtgtggtgagtctatggtacttattgatgttgatgtgccatttacagcccactttgctcttaaagataagttgttttgtgcatttattactaagcgtagtgtgtacaaagcagcttgtgttgtggatgttaatgatagtcattctatggctgttgttgatggtaaacaaattgatgatcatcgtatcactagtattactagtgataagtttgattttattattgggcatggtatgtcattttcaatgactacttttgaaattgcccaattgtatggttcttgtataacacctaatgtatgttttgttaaaggtgatataattaaagtttctaagcgtgttaaagcagaagtcgttgtaaatcctgctaatggccatatggcacatggtggtggtgttgcaaaggctattgcagtagcagctggacagcagtttgttaaagagaccaccgatatggttaagtctaaaggagtttgtgctactggagattgttatgtctctacagggggcaaattatgtaaaactgtgcttaatgttgttggacctgatgcgaggacacagggtaaacaaagttatgcattgttagagcgtgtttataaacatcttaacaaatatgattgtgttgttacaactttgatctcagctggtatatttagtgtgccttctgatgtgtctttaacatatctacttggtactgctaagaaacaagttgttcttgttagcaataatcaagaggattttgatcttatttctaagtgtcagataactgccgttgagggcactaagaaattggcagagcgtctttcttttaatgttgggcgttctatcgtttacgaaacagatgctaataagttgattttaagcaatgacgttgcatttgtttcgacatttaatgtcttacaggatgttttatccttaagacatgatatagcacttgatgatgatgcacgaacctttgttcagagcaatgttgatgttgtacctgagggttggcgtgttgtcaataagttttatcaaattaatggtgttagaaccgttaagtattttgagtgtcccgggggcatagatatatgcagccaggataaagtttttggttatgtacagcagggtagttttaataaggctactgttgctcaaattaaagccttgtttttggataaagtggacatcttgctaactgttgatggtgttaatttcactaacaggtttgtgcctgtaggtgaaagttttggtaagagtctaggaaatgtgttttgtgatggagttaatgtcacgaaacataagtgtgatataaattataaaggtaaagtctttttccagtttgataatctttctagtgaagatttaaaggctgtaagaagttcttttaattttgatcagaaggaattgcttgcctactacaacatgcttgttaattgttctaagtggcaggttgtttttaatggtaagtatttcacttttaagcaagctaataacaattgttttgttaatgtttcttgcttaatgctccagagtttgaatctgaaatttaaaattgttcaatggcaggaggcgtggcttgaatttcgttctggccgccccgctagatttgtatctttggttttggctaaaggtgggtttaaatttggggatcctgctgattctagagatttcttgcgtgttgtgtttagtcaagttgatttgacaggggcaatatgtgattttgaaattgcatgtaaatgtggtgtaaagcaggaacagcgtactggtgtggacgctgttatgcattttggtacattgagtcgtgaagatcttgagattggctacaccgtggattgttcttgcggtaaaaagctaattcattgtgtacgatttgatgtaccatttttaatttgcagtaatacacctgctagtgtaaaattacctaagggtgtaggaagtgcaaatatttttaaaggtgataaggttggtcattatgttcatgttaagtgtgaacagtcttatcagctttatgatgcttctaatgttaagaaggttacagacgttactggcaatttgtcagattgtttgtatcttaaaaatttgaaacaaacttttaaatcggtgttaaccacctattatttggatgatgttaagaaaattgagtataaacctgacttgtcacaatattattgtgacggaggtaagtattatactcagcgtattattaaagcccaatttaaaacatttgagaaagtagatggtgtgtatactaactttaaattgataggacacaccgtctgtgatattcttaatgctaagttgggttttgatagctctaaagagtttgttgaatataaggttactgagtggccaacagctacaggtgatgtggtgttggctactgatgatttgtatgttaagagatatgaaaggggttgtattacttttggtaaacctgttatatggttaagccatgagcaagcttccctcaattctttaacatattttaatagacctttattggttgatgagaataaatttgatgttttaaaagtggatgatgttgacgatggtggtgatatctcagagagtgatgctaaagaacccaaagaaatcaacattattaagttaagtggtgttaaaaaaccatttaaggttgaagatagtgtcattgttaatgatgatactagtgaaatcaaatatgttaagagtttgtctatagttgatgtgtatgatatgtggcttacaggttgtaggtgtgttgttaggactgctaatgctttgagcagagcagttaacgtacctacaatacgtaagtttataaaatttggtatgactcttgttagtataccaattgatttgttaaatttaagagagattaagcctgtttttaatgtggttaaagctgtgcgaaataaaatttctgcatgctttaattttattaaatggctttttgtcttattatttggctggattaaaatatccgctgataataaagtaatttacaccacagaagttgcatcaaagcttacgtgtaagcttgtagctttagcttttaaaaatgcatttttgacatttaagtggagtgtggttgctagaggtgcttgcattatagcgactatatttctattgtggtttaattttatatatgccaatgtaatttttagtgatttttatttgcctaaaatcggtttcttgccgacttttgttggtaagatcgcacagtggattaagaacacttttagtcttgtaactatttgtgatctatattccattcaggatgtgggttttaagaatcagtattgtaatggaagtatcgcatgtcagttctgcttggcaggatttgatatgttagataattataaagccattgatgtagtacagtatgaagctgataggagagcatttgttgattatacaggtgtgttaaagattgtcattgaattgatagttagttacgccctgtatacggcatggttttacccattgtttgctcttattagtattcagatcttgaccacttggctgcctgagctttttatgcttagtacattacattggagtgttaggttgctggtgtctttagctaatatgttaccagcacatgtgtttatgaggttttatattattattgcctcttttattaagctgtttagcttgtttaggcatgttgcctatggttgtagtaaatctggttgtttgttttgttacaagaggaatcgtagtctacgtgttaaatgtagtactattgttggtggcatgatacgctattacgatgctatggctaatggtggcactggcttttgttcaaaacatcaatggaattgcattgattgtgattcttataaaccaggtaatacttttattactgttgaggccgctcttgatttatctaaggaattgaaacggcctattcagcctacagatgttgcttatcatacggttacggatgttaagcaagttggttgttatatgcgcttgttctatgatcgtgatggacagcgcacatatgatgatgttaatgctagtttgtttgtggattatagtaatttgctacattctaaggttaagagtgtgcctaatatgcatgttgtggtagtggaaaatgatgccgataaagctaattttcttaatgctgctgtattttatgcacagtctttgtttagacctattttaatggttgataaaaatctgataactactgctaatactggtacgtctgttacagaaactatgtttgatgtttatgtggatacatttttgtctatgtttgatgtggataaaaagagtcttaatgctttaatagcaactgcgcattcttctataaaacagggtacgcagatctgtaaagttttggatacctttttaagctgtgctcgtaaaagttgttctattgattcagatgttgatactaagtgtttagctgattctgtcatgtctgctgtatcggcaggccttgaattgacggatgaaagttgtaataacttggtgccaacatatttgaagggtgataacattgtggcagctgatttaggtgttctgattcaaaattctgctaagcatgtgcagggtaatgttgctaaaatagccggtgtttcctgtatatggtctgtggatgcttttaatcagcttagttctgatttccagcataaattgaagaaagcatgttgtaaaactggtttgaaactgaagcttacttataataagcagatggctaatgtctctgttttaactacaccctttagtcttaaagggggtgcagtttttagttattttgtttatgtatgttttgtgttgagtttggtttgttttattggattgtggtgcttaatgcccacttacacagtacacaaatcagattttcagcttcccgtttatgccagttataaagttttagataatggtgttattagagatgttagcgttgaagatgtttgtttcgctaacaaatttgaacaatttgatcaatggtatgagtctacatttggtctaagttattatagtaacagtatggcttgtcccattgttgttgctgtagtagaccaggattttggctctactgtgtttaatgtccctaccaaagtgttacgatatggttaccatgtgttgcactttattacacatgcactttctgctgatggagtgcagtgttatacgccacatagtcaaatatcgtattctaatttttatgctagtggctgtgtgctttcctctgcttgcactatgtttgcaatggccgatggtagtccacaaccttattgttatacagatgggcttatgcagaatgcttctctgtatagttcattggtacctcatgtgcggtataatcttgctaatgctaaaggttttatccgttttccagaagtgttgcgagaaggacttgtgcgtattgtgcgtactcgttctatgccgtattgcagagttggattatgtgaggaagctgatgagggtatatgctttaattttaatggttcttgggtgcttaataatgattattatagatcattgcctgggaccttttgtggtagagatgtttttgacttaatttatcagctgtttaaaggtttagcacagcctgtggatttcttggcattgactgctagttccattgctggtgctatacttgctgtaattgttgttttggtgttttattacttaataaagcttaaacgtgcttttggtgattacaccagtattgtttttgttaatgtgattgtgtggtgtgtaaattttatgatgctttttgtgtttcaagtttaccctacactttcttgtgtatatgctatttgttatttttatgccacgctttatttcccttcggagataagtgtgataatgcatttacaatggctagttatgtatggcactattatgcctttatggttttgtttgctatatatatctgttgttgtttcaaatcatgctttttgggtattttcttactgcagacagcttggtacttctgttcgtagtgatggtacatttgaagaaatggctcttactacttttatgattacaaaagattcttattgtaagcttaagaattctttgtctgatgttgcttttaatagatatttgagtttgtataataaatataggtattacagcggtaaaatggatactgctgcatatagggaggctgcttgttctcagttggctaaagcaatggatacatttaccaataataatggtagtgatgtgctttaccaaccgcctactgcttccgtttcaacttcattcttgcaatctggtattgtgaaaatggttaatcctacttctaaggtagaaccatgtattgtcagtgttacctatggtaatatgacattgaatggtttatggttgggtgataaggtctactgtcccagacatgtgatatgttctgcttcagatatgactaatccagattatacaaatttgttgtgtagagtaacatcaagtgattttactgtattgtttgatcgtctaagccttacagtgatgtcttatcaaatgcagggttgtatgcttgttcttacagtgaccctgcaaaattctcgtacgccaaaatatacatttggtgtggttaaacctggtgagacttttactgttttagctgcttataacggcaaaccacaaggagcctttcatgtgactatgcgtagtagttataccattaagggttcctttttatgcggatcttgtggatctgttgtttatgtaataatgggtgattgtgttaaatttgtgtatatgcatcaattggagcttagtactggttgtcatactggtactgatttcaatggggatttttatggtccttataaggatgctcaggttgtccaattgcccgttcaggattatatacaatctgttaattttgtagcatggctttatgctgctatacttaataattgtaattggtttgtacaaagtgataagtgttctgttgaagattttaatgtgtgggctttgtctaatgggtttagccaagttaagtctgatcttgttatagatgctttagcttctatgactggtgtgtctttggaaacactattggctgctattaagcatcttaagaatggttttcaaggacgtcagattatgggtagttgctcctttgaggatgaattgacacctagcgatgtttatcaacaactcgctggtatcaagttacaatcaaagcgtactagattggttaaaggcattgtttgttggattatggcttctacatttttgtttagttgtataattacagcatttgtgaaatggactatgtttatgtatgtaactactaatatgcttagtattacgttttgtgcactttgtgttataagtttgaccatgttgttggttaaacataagcatctttatttgactatgtatataattcctgtgctttttacactgctgtataacaactatttggttgtgtacaagcagacatttagaggctatgtttatgcatggctatcatattatgttccatcagttgagtatacttatactgatgaagtaatttatggcatgttattgcttataggaatggtctttgttacattacgtagcattaaccagtatttgttctcttttataatgtttgttggtcgtgtgatttctgttgtctctttgtggtacatgggttctaacttagaggaagaaattcttcttatgttggcttctctttttggtacttacacatggacaacagctttatctatggctgcagcaaaggttattgctaagtgggttgccgtgaatgttttgtatttcacagatatacctcaaattaagatagtgcttgtatgctatttgtttataggttatattattagctgttattggggtttgttttccttgatgaacagtttgtttagaatgcctttgggtgtttataattataaaatttcagtacaggaattaagatatatgaatgctaatggattgcgccctcctaagaatagttttgaagcccttatgcttaattttaagcttttgggtattggaggtgtgccaattattgaagtatctcaatttcaatcaaaattgactgatgttaaatgtgctaatgttgtcttgcttaattgcttgcaacatttgcatgttgcttctaactctaagttgtggcaatattgtagcactttgcacaatgaaatacttgccacttctgatctgggtgttgcttttgaaaagcttgctcagttgttaattgttttgtttgctaatccagctgctgtggatagcaagtgcctgactagtattgaagaagtttgcgacgattacgcaaaggacaatactgttttgcaggctttacagagtgaatttgttaatatggctagcttcgttgaatatgaagttgctaagaaaaatcttgatgaggcgtgttctagtggttctgctaatcaacagcagttaaaacagctagagaaagcctgtaatattgctaaatctgcttatgaacgcgaccgtgctgtagcaagaaagttggagcgtatggcagatttggctctcactaatatgtataaagaagctagaattaatgataagaagagtaaggttgtttctgccttgcaaactatgctttttagtatggtgcgtaagttagataatcaagctctgaattcaatattagataatgctgtgaagggttgtgtaccattgaatgcaatcccttcattggcagcaaatactctgactataattgtaccagataaaagtgtttatgatcaggtagttgacaatgtctatgttacctatgcgggtaatgtatggcagattcaaactatccaagattcagatggtacaaataagcagttgcatgagatatctgatgattgtaactggccactagttattattgcaaatcggcataatgaggtatctgctaccgctttgcaaaataatgaattaatgcctgctaagttgaaaactcaggttgttaatagtggtccagatcagacttgtaatacacctactcaatgttactataataatagttacaatgggaagattgtttatgctatacttagtgatgttgatggtcttaagtatacaaaaattcttaaagatgatggcaattttgttgttttggagttagatcctccttgtaaatttactgttcaagatgttaaaggtcttaaaattaagtacctttattttgtaaaaggttgtaacacactagcaagaggctgggttgttggtacaatttcttctacagttagattgcaagctggaactgctactgagtatgcttccaactcatctatattatctttatgtgcgttttctgtagatcctaagaaaacgtatttagattttatacaacagggaggaacacctattgccaattgtgttaaaatgttgtgtgaccatgctggtaccggtatggccattactgttaaacccgatgctaccactagtcaggattcatatggtggtgcgtctgtttgtatatattgccgcgcacgagttgaacacccagatgttgatgggttgtgcaaattacgcggcaagtttgtacaagtgcctgtaggtataaaagatcctgtgtcttatgttttgacacatgatgtttgtcaagtttgtggattttggcgggatggaagctgttcatgtgttagcactgacactactgttcagtcaaaagatactaattttttaaacgggttcggggtacgagtgtagatgcccgtctcgtaccctgtgccagtggtttatctactgatgtacaattaagggcatttgatatttgcaatgctagtgttgctggcattggtttacatttaaaagttaattgctgccgttttcagcgtgttgatgagaacggtgataaattagatcagttctttgttgttaagaggacagatctgactatatataatagagagatggaatgctatgagcgtgtaaaagattgtaagtttgtggctgaacacgatttctttacatttgatgtagaaggtagtcgtgtgccacacattgtacgcaaggatttaacaaagtatactatgttggatctttgctatgcattgcgacattttgatcgcaatgattgcatgctgctttgtgacattctctctatatatgctggttgtgaacaatcctactttactaagaaggattggtatgattttgttgaaaatcctgatattattaatgtttataaaaagctaggacctatttttaatagagccctagttagcgctactgagtttgcagacaaattggtggaggtaggcttagtaggcattttaacacttgataaccaagatttaaatggtaaatggtatgattttggtgactatgttattgcagccccagggtgtggtgttgctatagcagactcttattattcttatatgatgcctatgctgaccatgtgtcatgcattggattgtgaattgtatgtgaataatgcttatagactatttgatcttgtacagtatgattttactgattacaagctcgaattgtttaataagtattttaagcactggagtatgccataccatcctaacacggttgattgtcaggatgatcggtgtatcatacgttgtgctaattttaacatactttttagtatggttttacctaatacatgttttgggcctcttgttaggcaaatttttgtggatggtgtgccttttgttgtttcaattggctaccattataaagaacttggtattgtgatgaacatggatgtggatacacatcgttatcgcttgtctttaaaagacttgcttttatatgctgctgatccagctttgcatgtagcttctgctagtgcattgtatgatttacgcacttgctgttttagtgttgcggctataacaagcggtgtaaaatttcaaacagttaaacctggtaattttaatcaggatttttatgattttattttaagtaagggcctgcttaaagagggtagttcagttgatctgaagcactttttctttacgcaggatggtaatgctgctattactgattataattattataagtacaatttgcccaccatggtggacattaagcagttgttgtttgttttggaagttgtttataagtattttgagatttatgatggtgggtgtataccggcatcacaagtcattgttaataattatgataagagtgctggctatccatttaataaatttggaaaagccaggctctattatgaagcattatcatttgaggagcaggatgaaatttacgcctatactaagcgcaatgtcctgccaacacttactcaaatgaatttgaaatatgctattagtgctaagaatagagcccgcactgttgctggtgtttccatacttagtactatgactggcagaatgtttcatcaaaaatgtttgaaaagtatagcagctacacgtggtgttcctgttgttataggcaccactaagttttatggcggctgggatgatatgttacgtcgccttattaaagatgttgataatcctgtacttatgggttgggattatcctaagtgtgatcgtgctatgccaaacatactacgtattgttagtagtctggtcttggcccgaaaacatgaggcatgttgttcgcaaagcgataggttttatcgacttgcgaatgaatacgcacaagttctgagtgaaattgttatgtgtggtggctgttattatgttaagcctggtggcactagtagtggtgatgcaactactgcttttgctaattcagtttttaacatatgtcaagctgtttcagccaatgtatgtgctttaatgtcatgcaatggtaataagattgaagatttgagtatacgtgctcttcagaagcgcttatactcacatgtgtatagaagtgatatggttgattcaacctttgtcacagaatattatgaatttttaaataagcattttagtatgatgattttgagtgatgatggcgttgtgtgttataattctgattatgcgtccaaagggtatattgctaatataagtgcctttcaacaggtattgtattatcaaaataacgtttttatgtcagaatccaaatgttgggttgaaaatgacataaacaatggacctcatgaattctgttcacaacatacaatgcttgtaaagatggatggggacgatgtctatcttccatatcctgatcctagtcgtatattaggagctggatgttttgtagatgatttgttaaagactgatagtgttcttttaatagaacgatttgtaagtcttgcaatagatgcttatccacttgtgtaccacgaaaatgaagaataccaaaaggtttttcgtgtttatttggagtatataaagaagttgtacaatgaactgggtaatcagatcttggatagctacagtgttattttaagtacttgtgatggacaaaagtttactgatgagtccttttacaagaacatgtatttaagaagtgcagttatgcagagtgttggagcttgcgtggtctgctcttctcaaacatcattacgttgtggcagttgcatcagaaagcctcttctttgctgcaagtgttgttacgatcatgttatggcaactgatcataaatatgttttgagtgtttcaccatatgtgtgtaacgcaccaggatgtgatgtaaatgatgttaccaaattgtatctaggtggtatgtcatattattgtgaagatcataagccacaatattcgtttaagttggtaatgaatggtatggtttttggtctatataaacaatcttgtacaggatctccgtacatagatgattttaatcgtatagctagttgtaaatggactgatgttgatgattacatactggctaatgaatgtacagagcgcttgaaattgtttgctgcagaaacgcaaaaggcgactgaggaagcctttaagcagagttatgcatcagcaacaatacaagagattgttagtgagcgcgaattgattctctcttgggagattggaaaagtgaagccaccacttaataaaaattatgtttttactggctaccattttactaaaaatggcaagacagttttaggtgagtatgtttttgataagagtgagttgactaatggtgtgtattatcgcgccacaaccacttataagctatctgtaggagatgtttttgttttaacctctcattcagtagctaatttaagtgctcctacgcttgtgccgcaggagaattatagtagtattagatttgctagtgtttatagtgtgcttgagacatttcagaacaatgttgtgaactatcaacacattggtatgaaacgttattgcaccgtgcaaggacctcctggtacaggaaagtcacatcttgctattggtcttgctgtatattattgtacagcacgtgtagtatacactgcggccagccatgcagctgttgacgcattgtgtgaaaaagcatacaaatttttgaatataaatgattgcactcgtattgttcctgccaaggtcagggtggagtgctatgataagtttaaaattaatgacaccactcgtaagtatgtgtttactactataaatgcattacctgagatggtgactgatattgttgttgtagatgaagttagtatgcttaccaattatgagctttctgttattaatgctcgtattcgcgctaagcattatgtttatattggtgatcctgctcaattgccagcaccacgtgtgttattgagcaagggtacacttgaacctaaatattttaacactgttactaagcttatgtgttgcttagggccagacatttttcttggtacatgttatagatgtcctaaggaaatcgttgatacagtgtctgccttggtttatgaaaataagcttaaggctaagaatgaaagtagttcattgtgttttaaggtctattataaaggcgttacaacacatgaaagttctagtgctgtaaatatgcagcagatttatttgattaataagtttttgaaggctaaccctttgtggcataaagccgtttttattagcccatataatagtcagaactttgcagctaggcgcgttttgggtttgcaaacccaaaccgtggattctgcgcaaggttctgaatatgattatgttatatattcacagactgcagaaacagcgcattctgtaaatgttaatcgcttcaatgttgctattactcgagccaagaaaggtattctttgcgttatgagtaatatgcagttgtttgaagcattacagtttactacattgaccgtagataaagtgccacaggccgttgaaacgagagttcaatgtagtaccaatttatttaaagattgtagcaagagttatagtggttaccacccagctcatgctccttcatttttggcagtagatgacaaatataaggcaactggcgatttagccgtgtgtcttggtattggagattctgctgttacatattcaagattaacatcactcatgggttttaaactggatgttacccttgatgggtattgtaagctttttataactaaagaagaagctgttaaacgcgtgcgtgcttgggttggctttgatgctgaaggtgctcatgccacgcgtgatagcattgggacaaatttcccacttcaattagggttttccacaggaattgattttgttgtggaagccactggtttgtttgctgatagagatggttacagctttaaaaaggctgtggctaaagctcctcctggtgaacaatttaagcatctcatccctttgatgacgagaggtcagcgctgggatgttgttagacctagaatagtacaaatgtttgcagatcatttaattgatctgtctgattgtgttgtgctagttacatgggcagccaactttgagctcacttgtctccgctactttgcaaaagtaggtcgtgagatctcttgtaatgtgtgcactaaacgtgccacagcttacaattctagaactggttactatggttgttggcgccatagtgttacatgtgattacttgtataatccacttattgttgatattcaacagtggggatatattggttctttatcaagtaatcatgatttatattgtagtgtccataaaggagcacatgttgcctcctctgatgctataatgacacggtgtttggccgtttatgattgtttttgcaataatattaattggaatgtggagtatcccatcatttcaaatgagttaagtattaatacctcttgtagggtcttgcagcgtgttatgcttaaagctgccatgctctgcaacagatatactttgtgttatgatattggcaatccaaaagcgattgcctgtgtcaaagattttgattttaagttctatgatgcccaaccaattgttaagtctgtcaagactcttttgtatttttttgaggcacataaggactcttttaaagatggtttgtgtatgttttggaactgtaatgtggataagtatccaccgaatgcagttgtatgtagatttgacacgagagtgttgaataatttaaatcttcctggctgtaatggaggtagtttgtatgttaacaaacatgcattccacactaaacccttttctagggcagcctttgagcatttgaagcctatgccatttttctattattcagatacgccttgcgtgtatatggatggcatggatgctaagcaggttgattatgtacctttgaaatccgccacttgcatcacaagatgcaatttagtgggtgcagtttgtttaaaacatgctgaagagtatcgtgagtacctaaattcttacaatacagctactacagcaggttttactttttgggtctataagacatttgatttttataatttgtggaatacgttcaccaagctacaaagcttggagaatgttgtatataatttagtcaagactggtcattatacaggacaggctggtgaaatgccttgtgccattataaatgataaagttgtggctaagatcgataaggaggatgttgtcatttttattaataatacaacatatcctactaatgtggctgttgaattatttgccaagcgcagtattcgacaccatccagagcttaagctctttagaaatttgaatatagacgtgtgctggaagcacgtcatttgggattatgctagagaaagtatattttgcagtaatacctatggtgtctgcatgtatacagatttaaagttcattgataaattgaatgtcctttttgatggtcgtgataatggtgctcttgaagcttttaaacgctctaataatggcgtttacatttccacgacaaaagttaagagtctttcgatgataagaggtccaccgcgtgctgaattaaatggcgtagtggtggacaaggttggagacacagattgtgtgttttattttgctgtgcgtaaagagggtcaggatgtcatcttcagccaattcgacagcctgagagtcagctctaaccagagcccacaaggtaatctggggagtaatgaacccggtaatgtcggtggtaatgatgctctggcaacctccactatctttacacaaagccgtgttattagctcttttacatgtcgtactgatatggaaaaagattttatagctttagatcaagatgtgtttattcagaagtatggtttggaggactatgcctttgaacacattgtttatggtaatttcaaccagaagattattggtggtttgcatttgttaataggcttgtaccgaagacagcaaacttccaatctggttattcaggagtttgtttcatacgactccagcatacactcttattttatcactgatgagaagagtggtggtagtaagagtgtttgcactgttatagatattttgttggatgattttgtggctcttgtcaagtcacttaatcttaactgtgtgagtaaggttgttaatgttaatgttgattttaaagattttcagttcatgctttggtgtaacgatgagaaagttatgactttctatcttcgtttgcaagctgcatctgactggaagcctggttattctatgcctgtattatataagtatttgaattccccaatggaaagagttagtctctggaattatgggaagccagttactttgcctacaggctgtatgatgaatgttgctaagtatactcagttatgtcaatatctgaatactacaacattagctgtacctgttaatatgcgagttttgcatttaggtgcaggttcagaaaaaggagtagcaccgggttctgcagttcttaggcagtggttgcctgctggtactattcttgtagataatgatttatacccatttgtgagtgacagtgtcgctacatattttggggattgtataaccttaccctttgattgtcaatgggatttgataatctctgatatgtatgaccctattactaagaacataggggagtacaatgtaagtaaagatggtttctttacatacatttgtcatatgattcgcgacaagttagctctgggtggcagtgttgctataaaaataacagagttttcttggaatgcagaattatataagttaatggggtattttgcattttggacggttttctgcacaaatgcaaatgcttcttctagtgaagggtttttaattggcataaattatttgggtaagcccaaggttgagatagatggaaatgttatgcatgccaattatttgttttggagaaattccacagtttggaacgggggtgcttatagcctgtttgatatggctaaattcccgcttaagttggctggtactgccgtaataaatttaagagcagaccagattaatgatatggtttattcccttcttgaaaagggtaaactacttgttagagatacaaataaagaagtttttgttggtgacagtatggttaatgtaatctaaactttaagaatggcagttgcttatgcagacaagcctaatcactttattaattttccacttacccagtttgagggttttgtgttaaattataaaggtttacaatttcaacttctcgatgaaggagtggattgtaaaatacaaacagcgccgcacattagtcttgctatgctggatattcagcctgaagactatagaagtgttgatgttgctattcaagaagttattgatgacatgcattggggtgagggctttcagattaaatttgataaccccctaatcctaggaagatgcatagttttagatgttaaaggtgtagaagaattgcatgatgatttagttaattacattcgtgataaaggttgtgttgctgaccaatccaggaaatggattggacattgcaccatagcccaactcacggatgctgcactttccattaaggaaaatgttgatttcataaacagcatgcaattcaattataaaatcactatcaacccctcatcaccggctagacttgaaatagttaagcttggtgctgaaaagaaagatggtttttatgaaaccatagttagccactggatgggaattcgttttgaatataatccacccactgataagctagctatgattatgggttattgttgtttagaagtggtgcgtaaagagctagaagaaggtgatcttcccgagaatgatgatgatgcttggtttaagctatcgtaccattatgaaaacaattcttggttctttcgacatgtctacaggaaaagttcttatttccgtaagtcttgtcaaaatttagattgtaattgtttggggttttatgaatctccagttgaagaagactaaactcagtgaaaatgtttttgcttcttagatttgttctagttagctgcataattggtagcctaggttttgataaccctcctaccaatgttgtttcgcatttaaatggagattggtttttatttggtgacagtcgttcagattgtaatcatgttgttaataccaacccccgtaattattcttatatggaccttaatcctgccctgtgtgattctggtaaaatatcatctaaagctggcaactccatttttaggagttttcactttaccgatttttataattacacaggcgaaggtcaacaaattattttttatgagggtgttaattttacgccttatcatgcctttaaatgcaccacttctggtagtaatgatatttggatgcagaataaaggcttgttttacactcaggtttataagaatatggctgtgtatcgcagccttacttttgttaatgtaccatatgtttataatggctctgcacaatctacagctctttgtaaatctggtagtttagttcttaataaccctgcatatatagctcgtgaagctaattttggggattattattataaggttgaagctgacttttatttgtcaggttgtgacgagtatatcgtaccactttgtatttttaacggcaagtttttgtcgaatacaaagtattatgatgatagtcaatattattttaataaagacactggtgttatttatggtctcaattctactgaaaccattaccactggttttgattttaattgtcattatttagttttaccctctggtaattatttagccatttcaaatgagctattgttaactgttcctacgaaagcaatctgtcttaacaagcgtaaggattttacgcctgtacaggttgttgattcacggtggaacaatgccaggcagtctgataacatgacggcggttgcttgtcaacccccgtactgttattttcgtaattctactaccaactatgttggtgtttatgatatcaatcatggggatgctggttttactagcatactcagtggtttgttatatgattcaccttgtttttcgcagcaaggtgtttttaggtatgataatgttagcagtgtctggcctctctattcctatggcagatgccctactgctgctgatattaatacccctgatgtacctatttgtgtgtatgatccgctaccacttattttgcttggcatccttttgggtgttgcggtcataattattgtagttttgttgttatattttatggtggataatggtactaggctgcatgatgcttagaccataatctaaacatgtttttgatacttttaatttccttaccaatggcttttgctgttataggagatttaaagtgtactacggtttccattaatgatgttgacaccggtgctccttctattagcactgatattgtcgatgttactaatggtttaggtacttattatgttttagatcgtgtgtatttaaatactacgttgttgcttaatggttactaccctacttcaggttctacatatcgtaatatggcactgaagggaactttactattgagcagactatggtttaaaccaccttttctttctgattttattaatggtatttttgctaaggtcaaaaataccaaggttattaaaaagggtgtaatgtatagtgagtttcctgctataactataggtagtacttttgtaaatacatcctatagtgtggtagtacaaccacatactaccaatttggataataaattacaaggtctcttagagatctctgtttgccagtatactatgtgcgagtacccacatacgatttgtcatcctaatctgggtaataaacgcgtagaactatggcattgggatacaggtgttgtttcctgtttatataagcgtaatttcacatatgatgtgaatgctgattacttgtatttccatttttatcaagaaggtggtactttttatgcatattttacagacactggtgttgttactaagtttctgtttaatgtttatttaggcacggtgctttcacattattatgtcctgcctttgacttgttctagtgctatgactttagaatattgggttacacctctcacttctaaacaatatttactagctttcaatcaagatggtgttatttttaatgctgttgattgtaagagtgattttatgagtgagattaagtgtaaaacactatctatagcaccatctactggtgtttatgaattaaacggttacactgttcagccaattgcagatgtttaccgacgtatacctaatcttcccgattgtaatatagaggcttggcttaatgataagtcggtgccctctccattaaattgggaacgtaagaccttttcaaattgtaattttaatatgagcagcctgatgtcttttattcaggcagactcatttacttgtaataatattgatgctgctaagatatatggtatgtgtttttccagcataactatagataagtttgctatacccaatggtaggaaggttgacctacaattgggcaatttgggctatttgcagtcttttaactatagaattgatactactgctacaagttgtcagttgtattataatttacctgctgctaatgtttctgttagcaggtttaatccttctacttggaataggagatttggttttacagaacaatttgtttttaagcctcaacctgtaggtgtttttactcatcatgatgttgtttatgcacaacattgttttaaagctccctcaaatttctgtccgtgtaaattggatgggtctttgtgtgtaggtaatggtcctggtatagatgctggttataaaaatagtggtataggcacttgtcctgcaggtactaattatttaacttgccataatgctgcccaatgtaattgtttgtgcactcccgaccccattacatctaaatctacagggccttacaagtgcccccaaactaaatacttagttggcataggtgagcactgttcgggtcttgctattaaaagtgattattgtggaggtaatccttgtacttgccaaccacaagcatttttgggctggtctgttgactcttgtttacaaggggataggtgtaatatttttgctaattttattttgcatgatgttaatagtggtactacttgttctactgatttacaaaaatcaaacacagacataattcttggtgtttgtgttaattatgatctttatggtattacaggccaaggtatttttgttgaggttaatgcgacttattataatagttggcagaaccttttatatgattctaatggtaatctctatggttttagagactacttaacaaacagaacttttatgattcgtagttgctatagcggtcgtgtttcagcggcctttcatgctaactcttccgaaccagcattgctatttcggaatattaaatgcaattacgtttttaataatactctttcacgacagctgcaacctattaactattttgatagttatcttggttgtgttgtcaatgctgataatagtacttctagtgttgttcaaacatgtgatctcacagtaggtagtggttactgtgtggattactctacaaaaagacgaagtcgtagagcgattaccactggttatcggtttactacttttgagccatttactgttaattcagtaaatgatagtttagaacctgtaggtggtttgtatgaaattcaaataccttcagagtttactataggtaatatggaggagtttattcaaacaagctctcctaaagttactattgattgttctgcttttgtctgtggtgattatgcagcatgtaaatcacagttggttgaatatggtagcttctgtgacaatattaatgctatactcacagaagtaaatgaactacttgacactacacagttgcaagtagctaatagtttaatgaatggtgtcactcttagcactaagcttaaagatggcgttaatttcaatgtagacgacatcaatttttcccctgtattaggttgtttaggaagcgattgtaataaagtttccagcagatctgctatagaggatttacttttttctaaagtaaagttatctgatgtcggtttcgttgaggcttataataattgtactggaggtgccgaaattagggacctcatttgtgtgcaaagttataatggtatcaaagtgttgcctccactgctctcagtaaatcagatcagtggatacactttggctgccacctctgctagtctgtttcctcctttgtcagcagcagtaggtgtaccattttatttaaatgttcagtatcgtattaatgggattggtgttaccatggatgtgttaagtcaaaatcaaaagcttattgctaatgcatttaacaatgctcttgatgctattcaggaagggtttgatgctaccaattctgctttagttaaaattcaagctgttgttaatgcaaatgctgaagctcttaataacttattgcaacaactctctaatagatttggtgctataagttcttctttacaagaaattctatctagactggatgctcttgaagcgcaagctcagatagacagacttattaatgggcgtcttaccgctcttaatgtttatgtttctcaacagcttagtgattctacactagtaaaatttagtgcagcacaagctatggagaaggttaatgaatgtgtcaaaagccaatcatctaggataaatttttgtggtaatggtaatcatattatatcattagtgcagaatgctccatatggtttgtattttatccactttagctatgtccctactaagtatgtcactgcgaaggttagtcccggtctgtgcattgctggtgatagaggtatagcccctaagagtggttattttgttaatgtaaataatacttggatgttcactggtagtggttattactaccctgaacccataactggaaataatgttgttgttatgagtacctgtgctgttaactatactaaagcgccggatgtaatgctgaacatttcaacacccaacctccatgattttaaggaagagttggatcaatggtttaaaaaccaaacatcagtggcaccagatttgtcacttgattatataaatgttacattcttggacctacaagatgaaatgaataggttacaggaggcaataaaagttttaaatcagagctacatcaatctcaaggacattggtacatatgagtattatgtaaaatggccttggtatgtatggcttttaattggctttgctggtgtagctatgcttgttttactattcttcatatgctgttgtacaggatgtgggactagttgttttaagatatgtggtggttgttgtgatgattatactggacaccaggagttagtaattaaaacatcacatgacgactaagttcgtctttgatttattggctcctgacgatatattacatcccttcaatcatgtgaagctaattataagacccattgaggtcgagcatattataatagctaccacaatgcctgctgtttagtgggtactgtgtcttatataactagtaaacctgtaatgccaatggctacaaccattgacggtacagattatactaatattatgcctagtactgtttctacaacagtttatttaggctgttctataggtattgacactagcaccactggttttacctgtttttcacggtactagttccaaaccatattataatttaggtagaccttataactttaagcattattaattgccaaagtttctaaggtcacgccctagtaatggacatctggagacctgagattaaatatctccgttatactaacggttttaatgtctcagaattagaagatgcttgttttaaatttaactataaatttcctaaagtaggatattgtagagttcctagtcatgcttggtgccgtaatcaaggtagcttttgtgctacactcactctttatggcaaatccaaacattatgataaatattttggagtaataactggttttacagcattcgctaatactgtagaggaggctgttaacaaactggttttcttagctgttgactttattacttggcggagacaggagttaaatgtttatggctgatgcttattttgcagacactgtgtggtatgtggggcaaataatttttatagttgccatttgtttattggttataatagttgtagtggcatttttggcaacttttaaattgtgtattcaactttgcggtatgtgtaataccttaggactgtccccttctatttatgtgtttaatagaggtaggcagttttatgagttttacaacgatgtaaaaccaccagttcttgatgtggatgacgtttagttaatccaaacattatgagtagtgtaactacaccagcaccagtttacacctggactgctgatgaagctattaaattcctaaaggaatggaacttttctttgggtattatactactttttattacaatcatattgcaatttggatatacaagtcgcagtatgtttgtttatgttattaagatgatcattttgtggcttatgtggccccttactatcatcttaactattttcaattgcgtgtatgcgttgaataatgtgtatcttggcttttctatagttttcactatagtggccattatcatgtggattgtgtattttgtgaatagtatcaggttgtttattagaactggaagttggtggagtttcaacccagaaacaaacaacttgatgtgtatagatatgaagggaaggatgtatgttaggccgataattgaggactaccatacccttacggtcacaataatacgtggtcatctttacatgcaaggtataaaactaggtactggctattctttgtcagatttgccagcttatgtgactgttgctaaggtctcacacctgctcacgtataagcgtggttttcttgacaagataggcgatactagtggttttgctgtttatgttaagtccaaagtcggtaattaccgactgccatcaacccaaaagggttctggcatggacaccgcattgttgagaaataatatctaaactttaaggatgtcttttactcctggtaagcaatccagtagtagagcgtcctttggaaatcgttctggtaatggcatccttaagtgggccgatcagtccgaccaatctagaaatgttcaaaccaggggtagaagagctcaacccaagcaaactgctacttctcagctaccatcaggagggaatgttgtaccctactattcttggttctctggaattactcagtttcaaaaaggaaaggagtttgaatttgcagagggacaaggtgtgcctattgcaccaggagtcccagctactgaagctaaggggtactggtacagacacaacagacgttcttttaaaacagccgatggcaaccagcgtcaactgctgccacgatggtatttttactatcttggaacaggaccgcatgccaaagaccagtatggcaccgatattgacggagtcttctgggtcgctagtaaccaggctgatgtcaataccccggctgacattctcgatcgggacccaagtagcgatgaggctattccgactaggtttccgcctggcacggtactccctcagggttactatattgaaggctcaggaaggtctgctcctaattccagatctacttcacgcgcatccagtagagcctctagtgcaggatcgcgtagtagagccaattctggcaacagaacccctacctctggtgtaacacctgatatggctgatcaaattgctagtcttgttctggcaaaacttggcaaggatgccactaagccacagcaagtaactaagcagactgccaaagaaatcagacagaaaattttgaataagccccgccagaagaggagccccaataaacaatgcactgttcagcagtgttttgggaagagaggccccaatcagaattttggtggtggagaaatgttaaaacttggaactagtgacccacagttccccattcttgcagaactcgcacccacagctggtgcgtttttctttggatcaagattagagttggccaaagtgcagaatttgtctgggaatcttgacgagccccagaaggatgtttatgaattgcgctataatggtgcaattagatttgacagtacactttcaggttttgagaccataatgaaggtgttgaatgagaatttgaatgcatatcaacaacaagatggtatgatgaatatgagtccaaaaccacagcgtcagcgtggtcagaagaatggacaaggagaaaatgataatataagtgttgcagcgcctaaaagccgtgtgcagcaaaataagagtagagagttgactgcagaggacatcagccttcttaagaagatggatgagccctatactgaagacacctcagaaatataagagaatgaaccttatgtcggcacctggtggtaagccctcgcaggaaagtcgggataaggcactctctatcagaatggatgtcttgctgctataatagatagagaaggttatagcagactatagattaattagttgaaagttttgtgtggtaatgtatagtgttggagaaagtgaaagacttgcggaagtaattgccgaacaagtgcccaagggaagagccagcatgttaagttaccacccagtaattagtaaatgaatgaagttaattatggccaattggaagaatcac

SEQ ID NO: 24 - DNA, 31100 bp, Coronavirus
gattgtgagcgatttgcgtgcgtgcatcccgcttcactgatctcttgttagatctttttataatctaaactttataaaaacatccactccctgtattctatgcttgtgggcgtagatttttcatagtggtgtctatattcatttctgctgttaacagctttcagccagggacgtgttgtatcctaggcagtggcccacccataggtcacaatgtcgaagatcaacaaatacggtctcgaactacactgggctccagaatttccatggatgtttgaggacgcagaggagaagttggataaccctagtagttcagaggtggatatagtatgctccaccactgcgcaaaagctggaaacaggcggaatttgtcctgaaaatcatgtgatggtggattgtcgccgacttcttaaacaagagtgttgtgtgcagtctagcctaatacgtgaaattgttatgaatacacgtccatatgatttggaggtgctacttcaagatgctttgcagtcccgcgaagcagttttggttacaccccctctaggtatgtctctggaggcatgctatgtgagaggttgtaatcctaatggatggaccatgggtttgtttcggcgtagaagtgtgtgtaacactggtcgttgcgctgttaacaagcatgtggcctatcagctatatatgattgatcctgcgggtgtctgttttggtgcaggtcaatttgtgggttgggttatacccttagcctttatgcctgtgcaatcccggaaatttattgctccttgggttatgtacttgcgtaagtgtggcgaaaagggtgcctacattaaagattataaacgtggcggttttgaacacgtttataattttaaagttgaggatgcttacgacctggttcatgatgagcctaagggtaagttttctaagaaggcttatgctttaattagaggataccgtggtgttaaaccgcttctctatgtagaccagtatggttgtgattatactggtggtcttgcagatggcttagaggcttatgctgataagacattgcaagaaatgaaggcattatttcctatttggagccaggaactcccttttgatgtaactgtggcatggcacgttgtgcgtgatccacgttatgttatgagactgcagagtgcttctactatacgtagtgttgcatatgttgctaaccctactgaagacttgtgtgatggttctgttgttataaaggaacctgtgcatgtttatgcggatgactctattattttacgtcaacataatttagttgacattatgagttgtttttatatggaggcagatgcagttgtaaatgctttttatggtgttgatttgaaagattgtggttttgttatgcagtttggttatattgactgcgaacaagacttgtgtgattttaaaggttgggttcctggtaatatgatagatggttttgcttgcactacttgtggtcatgtttatgagacaggtgatttgctagcacaatcttcaggtgttttgcctgttaatcctgtattgcatactaagagtgcagcaggttatggtggttttggttgtaaggattcttttaccctgtatggccaaactgtagtttattttggaggttgtgtgtattggagtccagcacgtaatatatggattcctatattaaaatcttctgttaagtcttatgacggtttggtttatactggagttgtaggttgcaaggctattgtaaaggaaacaaatctcatttgcaaagcgttgtaccttgattatgttcaacacaagtgtggcaatttacaccagcgggagttgctaggtgtgtcagatgtgtggcataaacaattgttattaaatagaggtgtgtacaaacctcttttagagaatattgattattttaatatgcggcgcgctaaatttagtttagaaacttttactgtttgtgcagatggttttatgccttttcttttagatgatttggttccgcgcgcatattatttggcagtaagtggtcaagcattttgtgactacgcaggtaaaatctgccatgctgttgtgtctaagagtaaagagttacttgatgtgtctgtggattctttaggtgcagctatacattatttgaattctaaaattgttgatttggctcaacattttagtgattttggaacaagtttcgtttctaaaattgttcatttctttaagacttttactactagcactgctcttgcatttgcatgggttttatttcatgttttgcatggtgcttatatagtagtggagagtgatatatattttggtaaaaacattcctcgttatgctagtgctgttgcacaagcatttcggagtggtgctaaagttggactggactctttaagagttacttttattgatggcctttcttgttttaagattggacgtagaagaatttgtctttcaggcagtaaaatttatgaagttgagcgtggcttgttacattcatctcaattgccattagatgtttatgatttaaccatgcctagtcaagttcagaaaaccaagcaaaaaggtatttatttaaaaggttctggttctgatttttcattagcggatagtgtagttgaagttgttacaacttcacttacaccatgtggttattctgaaccacctaaagttgcagataaaatttgcattgtggataatgtttatatggccaaggctggtgacaaatattaccctgttgtggttgatggtcatgttggacttttggatcaagcatggagggttccttgtgctggaaggtgtgttacatttaaggaacagcctacagtaaatgagattgcaagcacgcctaagactattaaagttttttatgagcttgacaaagattttaatactattttaaacactgcatgtggagagtttgaagtggatgatactgtggatatggaggaattttatgctgtggtgattgatgccatagaagagaaactttctccatgtaaggagcttgaaggtgtaggtgctaaagttagtgcctttttacagaaattagaggataattccctatttttatttgatgaggctggtgaggaagttcttgctcctaaattgtattgtgcttttacagctcctgaagatgatgactttcttgaagaaagtggtgttgaagaagatgatgtagaaggtgaggaaactgatttaactgtcacaagtgctggagagccttgtgttgccagtgaacaggaggagtcttctgaaatcttagaggacactttggatgatggtccatgtgtggagacatctgattcacaagttgaagaagatgtacaaatgtcggattttggtgatcttgaatctgtgattcaggattatgaaaatgtttgttttgagttttatactacagaaccagaatttgttaaagttttggatctgtatgttcctaaagcaactcgcaacaattgctggttgcgatcagttttggcagtgatgcagaaactgccctgtcaatttaaagataaaaatttgcaggatctttgggtgttatataagcaacagtatagtcagttgtttgttgataccttggttaataagatacctgctaatattgtagttccacaaggtggttatgttgctgattttgcatattggttcttaaccttatgtgattggcagtgtgttgcatactggaaatgcattaaatgtgatttagctcttaagcttaaaggcttggatgctatgttcttttatggtgatgttgtctcacatgtgtgcaagtgtggtgagtctatggtacttattgatgttgatgtgccatttacagcccactttgctcttaaagataagttgttttgtgcatttattactaagcgtagtgtgtataaagcagcttgtgttgtggatgttaatgatagtcattctatggctgttgttgatggtaaacaaattgatgatcatcgtatcactagtattactagtgataagtttgattttattattgggcatggtacgtcattttcaatgactacttttgaaattgcccaattgtatggttcttgtataacacctaatgtatgttttgttaaaggtgatataattaaagtttctaagcgagttaaagcagaagtcgttgtaaatcctgctaatggccatatggcacatggtggtggtgttgcaaaggctattgcagtagcagctggacagcagtttgttaaagagaccaccgatatggttaagtctaaaggagtttgtgctactggagattgttatgtctctacagggggcaaattatgtaaaactgtgcttaatgttgttggacctgatgcgaggacacagggtaaacaaagttatgcattgttagagcgtgtttataaacatcttaacaaatatgattgtgttgttacaactttgatctcagctggtatatttagtgtgccttctgatgtgtctttaacatatctacttggtactgctaagaaacaagttgttcttgttagcaataatcaagaggattttgatcttatttctaagtgtcagataactgccgttgagggcactaagaaattggcagagcgtctttcttttaatgttgggcgttctatcgtttacgaaacagatgctaataagttgattttaagcaatgacgttgcatttgtttcgacatttaatgtcttacaggatgttttatccttaagacatgatatagcacttgatgatgatgcacgaacctttgttcagagcaatgttgatgttgtacctgagggttggcgtgttgtcaataagttttatcaaattaatggtgttagacccgttaagtattttgagtgtcccgggggcatagatatatgcagccaggataaagtttttggttatgtacagcagggtagttttaataaggctactgttgctcaaattaaagccttgtttttggataaagtggacatcttgctaactgttgatggtgttaatttcactaacaggtttgtgcctgtaggtgaaagttttggtaagagtctaggaaatgtgttttgtgatggagttaatgtcacgaaacataagtgtgatataaattataaaggtaaagtctttttccagtttgataatctttctagtgaagatttaaaggctgtaagaagttcttttaattttgatcagaaggaattgcttgcctactacaacatgcttgttaattgttctaagtggcaggttgtttttaatggtaagtatttcacttttaagcaagctaataacaattgttttgttaatgtttcttgcttaatgctccagagtttgaatctgaaatttaaaattgttcaatggcaggaggcgtggcttgaatttcgttctggccgccctgctagatttgtatcgttggttttggctaaaggtggttttaaatttggggatcctgctgattctagagatttcttgcgtgttgtgtttagtcaagttgatttgacaggggcaatatgtgattttgaaattgcatgtaaatgtggtgtaaagcaggaacagcgtactggtgtggacgctgttatgcattttggtacattgagtcgtgaagatcttgagattggttacaccgtggattgttcttgcggtaaaaagctaattcattgtgtacgatttgatgtaccatttttaatttgcagtaatacacctgctagtgtaaaattacctaagggtgtaggaagtgcaaatatttttaaaggtgataaggttggtcattatgttcatgttaagtgtgaacagtcttatcagctttatgatgcttctaatgttaagaaggttacagacgttactggcaatttgtcagattgtttgtatcttaaaaatttgaaacaaacttttaaatcggtgttaaccacctattatttggatgatgttaagaaaattgagtataaacctgacttgtcacaatattattgtgacggaggtaagtattatactcagcgtattattaaagcccaatttaaaacatttgagaaagtagatggtgtgtatactaattttaaattgataggacacaccgtctgtgatattcttaatgctaagttgggttttgatagctctaaagagtttgttgaatataaggttactgagtggccaacagctacaggtgatgtggtgttggctactgatgatttgtatgttaagagatatgaaaggggttgtattacttttggtaaacctgttatatggttaagccatgagcaagcttccctcaattctttaacatattttaatagacctttattggttgatgagaataaatttgatgttttaaaagtggatgatgttgacgatggtggtgatatctcagagagtgatgctaaagaacccaaagaaatcaacattattaagttaagtggtgttaaaaaaccatttaaggttgaagatagtgtcattgttaatgatgatactagtgaaatcaaatatgttaagagtttgtctatagttgatgtgtatgatatgtggcttacaggttgtaggtgtgttgttaggactgctaatgctttgagcagagcagttaacgtacctacaatacgtaagtttataaaatttggtatgactcttgttagtataccaattgatttgttaaatttaagagagattaagcctgtttttaatgtggttaaagctgtgcgaaataaaatttctgcatgctttaattttattaaatggctttttgtcttattatttggctggattaaaatatccgctgataataaagtaatttacaccacagaagttgcatcaaagcttacgtgtaagcttgtagctttagcttttaaaaatgcatttttgacatttaagtggagtgtggttgctagaggtgcttgcattatagcgactatatttctattgtggtttaattttatatatgccaatgtaatttttagtgatttttatttgcctaaaatcggtttcttgccgacttttgttggtaagatcgtacagtggattaagaacacttttagtcttgtaactatttgtgatctatattccattcaggatgtgggttttaagaatcagtattgtaatggaagtatcgcatgtcagttctgcttggcaggatttgatatgttagataattataaagccattgatgtagtacagtatgaagctgataggagagcatttgttgattatacaggtgtgttaaagattgtcattgaattgatagttagttacgccctgtatacggcatggttttacccattgtttgctcttattagtattcagatcttgaccacttggctgcctgagcttcttatgcttagtacattacattggagtgttaggttgctggtgtctttagctaatatgttaccagcacatgtgtttatgaggttttatattattattgcctcttttattaagctgtttagcttgtttaggcatgttgcctatggttgtagtaaatctggttgtttgttttgttacaagaggaatcgtagtctacgtgttaaatgtagtactattgttggtggcatgatacgctattacgatgttatggctaatggtggcactggcttttgttcaaaacatcaatggaattgcattgattgtgattcttataaaccaggtaatacttttattactgttgaggccgctcttgatttatctaaggaattgaaacggcctattcagcctacagatgttgcttatcatacggttacggatgttaagcaagttggttgttatatgcgcttgttctatgatcgtgatggacagcgcacatatgatgatgttaatgctagtttgtttgtggattatagtaatttgctacattctaaggttaagagtgtgcctaatatgcatgttgtggtagtggaaaatgatgccgataaagctaattttctaaatgctgctgtattttatgcacagtctttgtttagacctattttaatggttgataaaatcttgataactactgctaatactggtacgtctgttacagaaactatgtttgatgtttatgtggatacatttttgtctatgtttgatgtggataaaaagagtcttaatgctttaatagcaactgcgcattcttctataaaacagggtacgcagatctgtaaagttttggatacctttttaagctgtgctcgtaaaagttgttctattgattcagatgttgatactaagtgtttagctgattctgtcatgtctgctgtatcggcaggccttgaattgacggatgaaagttgtaataacttggtgccaacatatttgaagggtgataacattgtggcagctgatttaggtgttctgattcaaaattctgctaagcatgtgcagggtaatgttgctaaaatagccggtgtttcctgtatatggtctgtggatgcttttaatcagcttagttctgatttccagcataaattgaagaaagcatgttgtaaaactggtttgaaacttgagcttacttataataagcagatggctaatgtctctgttttaactacaccctttagtcttaaagggggtgcagtttttagttattttgtttatgtatgttttgtgttgagtttggtttgttttattggattgtggtgcttaatgcccacttacacagtacacaaatcagattttcagcttcccgtttatgccagttataaagttttagataatggtgttattagagatgttagcgttgaagatgtttgtttcgctaacaaatttgaacaatttgatcaatggtatgagtctacatttggtctaagttattatagtaacagtatggcttgtcccattgttgttgctgtagtagaccaggattttggctctactgtgtttaatgtccctaccaaagtgttacgatatggttaccatgtgttgcactttattacacatgcactttctgctgatggagtgcagtgttatacgccacatagtcaaatatcgtattctaatttttatgctagtggctgtgtgctttcctctgcttgcactatgtttgcaatggccgatggtagtccacaaccttattgttatacagatgggcttatgcagaatgcttctctgtatagttcattggtacctcatgtgcggtataatcttgctaatgctaaaggttttatccgtcttccagaagtgttgcgagaaggacttgtgcgtattgtgcgtactcgttctatgtcgtattgcagagttggattatgtgaggaagctgatgagggtatatgctttaattttaatggttcttgggtgcttaataatgattattatagatcattgcctgggaccttttgtggtagagatgtttttgacttaatttatcagctgtttaaaggtttagcacagcctgtggatttcttggcattgactgctagttccattgctggtgctatacttgctgtaattgttgttttgggtttttattacttaataaagcttaaacgtgcttttggtgattacaccagtattgtttttgttaatgtgattgtgtggtgtgtaaattttatgatgctttttgtgtttcaagtttaccctacactttcttgtgtatatgctatttgttatttttatgccacgctttatttcccttcggagataagtgtgataatgcatttacaatggctagttatgtatggcactattatgcctttatggttttgtttgctatatatatctgttgttgtttcaaatcatgctttttgggtattttcttactgcagacagcttggtacttctgttcgtagtgatggtacatttgaagaaatggctcttactacttttatgattacaaaagattcttattgtaagcttaagaattctttgtctgatgttgcttttaatagatatttgagtttgtataataaatataggtattacagcggtaaaatggatactgctgcatatagggaggctgcttgttctcagttggctaaagcaatggatacatttaccaataataatggtagtgatgtgctttaccaaccgcctactgcttccgtttcaacttcattcttgcaatctggtattgtgaaaatggttaatcctacttctaaggtagaaccatgtattgtcagtgttacctatggtaatatgacattgaatggtttatggttggatgataaggtctactgtcccagacatgtgatatgttctgcttcagatatgactaatccagattatacaaatttgttgtgtagagtaacatcaagtgattttactgtattgtttgatcgtctaagccttacagtgatgtcttatcaaatgcagggttgtatgcttgttcttacagtgaccctgcaaaattctcgtacgccaaaatatacatttggtgtggttaaacctggtgagacttttactgttttagctgcttataacggcaaaccacaaggagcctttcatgtgactatgcgtagtagttataccattaagggttcctttttatgcggatcttgtggatctgttggttatgtaataatgggtgattgtgttaaatttgtgtatatgcatcaattggagcttagtactggttgtcatactggtactgatttcaatggggatttttatggtccttataaggatgctcaggttgtccaattgcccgttcaggattatatacaatctgttaattttgtagcatggctttatgctgctatacttaataattgtaattggtttgtacaaagtgataagtgttctgttgaagattttaatgtgtgggctttgtctaatgggtttagccaagttaagtctgatcttgttatagatgctttagcttctatgactggtgtgtctttggaaacactattggctgctattaagcgtcttaagaatggttttcaaggacgtcagattatgggtagttgctcctttgaggatgaattgacacctagcgatgtttatcaacaactcgctggtatcaagttacaatcaaagcgtactagattggttaaaggcattgtttgttggattatggcttctacatttttgtttagttgtataattacagcatttgtgaaatggactatgtttatgtatgtaactactaatatgcttagtattacgttttgtgcactttgtgttataagtttggccatgttgttggttaaacataagcatctttatttgactatgtatataattcctgtgctttttacactgctgtataacaactatttggttgtgtacaagcagacatttagaggctatgtttatgcatggctatcatattatgttccatcagttgagtatacttatactgatgaagtaatttatggcatgttattgcttataggaatggtctttgttacattacgtagcattaaccatgatttgttctcttttataatgtttgttggtcgtgtgatttctgttgtctctttgtggtacatgggttctaacttagaggaagaaattcttcttatgttggcttctctttttggtacttacacatggacaacagctttatctatggctgcagcaaaggttattgctaagtgggttgctgtgaatgttttgtatttcacagatatacctcaaattaagatagtgcttgtatgctatttgtttataggttatattattagctgttattggggtttgttttccttgatgaacagtttgtttagaatgcctttgggtgtttataattataaaatttcagtacaggaattaagatatatgaatgctaatggattgcgccctcctaagaatagttttgaagcccttatgcttaattttaagcttttgggtattggaggtgtgccaattattgaagtatctcaatttcaatcaaaattgactgatgttaaatgtgccaatggtggcttgcttaattgcttgcaacatttgcatgttgcttctaactctaagttgtggcaatattgtagcactttgcacaatgaaatacttgccacttctgatctgggtgttgcttttgaaaagcttgctcagttgttaattgttttgtttgctaatccagctgctgtggatagcaagtgcctgactagtattgaagaagtttgcgacgattacgcaaaggacaatactgttttgcaggctttacagagtgaatttgttaatatggctagcttcgttgaatatgaagttgctaagaaaaatcttgatgaggcgtgttctagtggttctgctaatcaacagcagttaaaacagctagagaaagcctgtaatattgctaaatctgcttatgaacgcgaccgtgctgtagcaagaaagttggagcgtatggcagatttggctctcactaatatgtataaagaagctagaattaatgataagaagagtaaggttgtttctgccttgcaaactatgctttttagtatggtgcgtaagttagataatcaagctctgaattcaatattagataatgctgtgaagggttgtgtaccattgaatgcaatcccttcattggcagcaaatactctgactataattgtaccagataaaagtgtttatgatcaggtagttgacaatgtctatgttacctatgcgggtaatgtatggcagattcaaactatccaagattcagatggtacaaataagcagttgcatgagatatctgatgattgtaactggccactagttattattgcaaatcggcataatgaggtatctgctaccgttttgcaaaataatgaattaatgcctgctaagttgaaaactcaggttgttaatagtggtccagatcagacttgtaatacacctactcaatgttactataataatagttacaatgggaagattgtttatgctatacttagtgatgttgatggtcttaagtatacaaaaattcttaaagatgatggcaattttgttgttttggagttagatcctccttgtaaatttactgttcaagatgttaaaggtcttaaaattaagtacctttattttgtaaaaggttgtaacacactagcaagaggctgggttgttggtacaatttcttctacagttagattgcaagctggaactgctactgagtatgcttccaactcatctatattatctttatgtgcgttttctgtagatcctaagaaaacgtatttagattttatacaacagggaggaacacctattgccaattgtgttaaaatgttgtgtgaccatgctggtaccggtatggccattactgttaaacccgatgctaccactagtcaggattcatatggtggtgcgtctgtttgtatatattgccgcgcacgagttgaacacccagatgttgatgggttgtgcaaattacgcggcaagtttgtacaagtgcctgtaggtataaaagatcctgtgtcttatgttttgacacatgatgtttgtcaagtttgtggattttggcgggatggaagctgttcatgtgttagcactgacactactgttcagtcaaaagatactaattttttaaacgggttcggggtacgagtgtagatgcccgtctcgtaccctgtgccagtggtttatctactgatgtacaattaagggcatttgatatttgcaatgctagtgttgctggcattggtttacatttaaaagttaattgctgccgttttcagcgtgttgatgagaacggtgataaattagatcagttctttgttgttaagaggacagatctgactatatataatagagagatggaatgctatgagcgtgtaaaagattgtaagtttgtggctgaacacgatttctttacatttgatgtagaaggtagtcgtgtgccacacattgtacgcaaggatttaacaaagtatactatgttggatctttgctatgcattgcgacattttgatcgcaatgattgcatgctgctttgtgacattctctctatatatgctggttgtgaacaatcctactttactaagaaggattggtatgattttgttgaaaatcctgatattattaatgtttataaaaagctaggacctatttttaatagagccctagttagcgctactgagtttgcagacaaattggtggaggtaggcttagtaggcattttaacacttgataaccaagatttaaatggtaaatggtatgattttggtgactatgttattgcagccccagggtgtggtgttgctatagcagactcttattattcttatatgatgcctatgctgaccatgtgtcatgcattggattgtgaattgtatgtgaataatgcttatagactatttgatcttgtacagtatgattttactgattacaagctcgaattgtttaataagtattttaagcactggagtatgccataccatcctaacacggttgattgtcaggatgatcggtgtatcatacattgtgctaattttaacatactttttagtatggttttacctaatacatgttttgggcctcttgttaggcaaatttttgtggatggtgtgccttttgttgtttcaattggctaccattataaagaacttggtattgtgatgaacatggatgtggatacacatcgttatcgcttgtctttaaaagacttgcttttatatgctgctgatccagctttgcatgtagcttctgctagtgcattgtatgatttacgcacttgctgttttagtgttgcggctataacaagcggtgtaaaatttcaaacagttaaacctggtaattttaatcaggatttttatgattttattttaagtaagggcctgcttaaagagggtagttcagttgatctgaagcactttttctttacgcaggatggtaatgctgctattactgattataattattataagtacaatttgcccaccatggtggacattaagcagttgttgtttgttttggaagttgtttataagtattttgagatttatgatggtgggtgtataccggcagcacaagtcattgttaataattatgataagagtgctggctatccatttaataaatttggaaaagccaggctctattatgaagcattatcatttgaggagcaggatgaaatttacgcctatactaagcgcaatgtcctgccaacacttactcaaatgaatttgaaatatgctattagtgctaagaatagagcccgcactgttgctggtgtttccatacttagtactatgactggcagaatgtttcatcaaaaatgtttgaaaagtatagcagctacacgtggtgttcctgttgttataggcaccactaagttttatggcggctgggatgatatgttacgtcgccttattaaagatgttgataatcctgtacttatgggttgggattatcctaagtgtgatcgtgctatgccaaacatactacgtattgttagtagtctggtcttggcccgaaaacatgaggcatgttgttcgcaaagcgataggttttatcgacttgcgaatgaatgcgcacaagttctgagtgaaattgttatgtgtggtggctgttattatgttaagcctggtggcactagtagtggtgatgcaactactgcttttgctaattcagtttttaacatatgtcaagctgtttcagccaatgtatgtgctttaatgtcatgcaatggtaataagattgaagatttgagtatacgtgctcttcagaagcgcttatactcacatgtgtatagaagtgatatggttgattcaacctttgtcacagaatattatgaatttttaaataagcattttagtatgatgattttgagtgatgatggcgttgtgtgttataattctgattatgcgtccaaagggtatattgctaatataagtgcctttcaacaggtattgtattatcaaaataacgtttttatgtcagaatccaaatgttgggttgaaaatgacataaacaatggacctcatgaattctgttcacaacatacaatgcttgtaaagatggatggggacgatgtctatcttccatatcctgtacctagtcgtatattaggagctggatgttttgtagatgatttgttaaagactgatagtgttcttttaatagaacgatttgtaagtcttgcaatagatgcttatccacttgtgtaccacgaaaatgaagaataccaaaaggtttttcgtgtttatttggagtatataaagaagttgtacaatgaactgggtaatcagatcttggatagctacagtgttattttaagtacttgtgatggacaaaagtttactgatgagtccttttacaagaacatgtatttaagaagtgcagttatgcagagtgttggagcttgcgtggtctgctcttctcaaacatcattacgttgtggcagttgcatcagaaagcctcttctttgctgcaagtgttgttacgatcatgttatggcaactgatcataaatatgttttgagtgtttcaccatatgtgtgtaacgcaccaggatgtgatgtaaatgatgttaccaaattgtatctaggtggtatgtcatattattgtgaagatcataagccacaatattcgtttaagttggtaatgaatggtatggtttttggtctatataaacaatcttgtacaggatctccgtacatagatgattttaatcgtatagctagttgtaaatggactgatgttgatgattacatactggctaatgaatgtacagagcgcttgaaattgtttgctgcagaaacgcaaaaggcgactgaggaagcctttaagcagagttatgcatcagcaacaatacaagagattgttagtgagcgcgaattgattctctcttgggagattggaaaagtgaagccaccacttaataaaaattatgtttttactggctaccattttactaaaaatggcaagacagttttaggtgagtatgtttttgataagagtgagttgactaatggtgtgtattatcgcgccacaaccacttataagctatctgtaggagatgtttttgttttaacctctcattcagtagctaatttaagtgctcctacgcttgtgccgcaggagaattatagtagtattagatttgctagtgtttatagtgtgcttgagacatttcagaacaatgttgtgaactatcaacacattggtatgaaacgttattgcaccgtgcaaggacctcctggtacaggaaagtcacatcttgctattggtcttgctgtatattattgtacagcacgtgtagtatacactgcggccagccatgcagctgttgacgcattgtgtgaaaaagcatacaaatttttgaatataaatgattgcactcgtattgttcctgccaaggtcagggtggagtgctatgataagtttaaaattaatgacaccactcgtaagtatgtgtttactactataaatgcattacctgagatggtgactgatattgttgttgtagatgaagttagtatgcttaccaattatgagctttctgttattaatgctcgtattcgcgctaagcattatgtttatattggtgatcctgctcaattgccagcaccacgtgtgttattgagcaagggtacacttgaacctaaatattttaacactgttactaagcttatgtgttgcttagggccagacatttttcttggtacatgttatagatgtcctaaggaaatcgttgatacagtgtctgccttggtttatgaaaataagcttaaggctaagaatgaaagtagttcattgtgttttaaggtctattacaaaggcgttacaacacatgaaagttctagtgctgtaaatatgcagcagatttatttgattaataagtttttgaaggctaaccctttgtggcataaagccgtttttattagcccatataatagtcagaactttgcagctaagcgcgttttgggtttgcaaacccaaaccgtggattctgcgcaaggttctgaatatgattatgttatatattcacagactgcagaaacagcgcattctgtaaatgttaatcgcttcaatgttgctattactcgagccaagaaaggtattctttgcgttatgagtaatatgcagttgtttgaagcattacagtttactacattgaccgtagataaagtgccacaggccgttgaaacgagagttcaatgtagtaccaatttatttaaagattgtagcaagagttatagtggttaccacccagctcatgctccttcatttttggcagtagatgacaaatataaggcaactggcgatttagccgtgtgtcttggtattggagattctgctgttacatattcaagattaatatcactcatgggttttaaactggatgttacccttgatgggtattgtaagctttttataactaaagaagaagctgttaaacgcgtgcgtgcttgggttggctttgatgctgaaggtgctcatgccacgcgtgatagcattgggacaaatttcccacttcaattagggttttccacaggaattgattttgttgtggaagccactggtttgtttgctgatagagatggttacagctttaaaaaggctgtggctaaagctcctcctggtgaacaatttaagcatctcatccctttgatgacgagaggtcagcgctgggatgttgttagacctagaatagtacaaatgtttgcagatcatttaattgatctgtctgattgtgttgtgctagttacatgggcagccaactttgagctcacttgtctccgctactttgcaaaagtaggtcgtgagatctcttgtaatgtgtcgactaaacgtgccacagcttacaattctagaactggttactatggttgttggcgccatagtgttacatgtgattacttgtataatccacttattgttgatattcaacagtggggatatattggttctttatcaagtaatcatgatttatattgtagtgtccataaaggagcacatgttgcctcctctgatgctataatgacacggtgtttggccgtttatgattgtttttgcaataatattaattggaatgtggagtatcccatcatttcaaatgagttaagtattaatacctcttgtagggtcttgcagcgtgttatgcttaaagctgccatgctctgcaacagatatactttgtgttatgatattggcaatccaaaagcgattgcctgtgtcaaagattttgattttaagttctatgatgcccaaccaattgttaagtctgtcaagactcttttgtatttttttgaggcacataaggactcttttaaagatggtttgtgtatgttttggaactgtaatgtggataagtatccaccgaatgcagttgtatgtagatttgacacgagagtgttgaataacttaaatcttcctggctgtaatggaggtagtttgtatgttaacaaacatgcattccacactaaacccttttctagggcagcctttgagcatttgaagcctatgccatttttctattattcagatacgccttgcgtgtatatggatggcatggatgctaagcaggttgattatgtacctttgaaatccgccacttgcatcacaagatgcaatttaggtggtgcagtttgtttaaaacatgctgaagagtatcgtgagtacctagagtcttacaatacagctactacagcaggttttactttttgggtctataagacatttgatttttataatttgtggaatacgttcaccaagctacaaagcttggagaatgttgtatataatttagtcaagactggtcattatacaggacaggctggtgaaatgccttgtgcaattataaatgataaagttgtggctaagatcgataaggaggatgttgtcatttttattaataatacaacatatcctactaatgtggctgttgaattatttgccaagcgcagtattcgacaccatccagagcttaagctctttagaaatttgaatatagacgtgtgctggaagcacgtcatttgggattatgctagagaaagtatattttgcagtaatacctatggtgtctgcatgtatacagatttaaagctcattgataaattgaatgtcctttttgatggtcgtgataatggtgctcttgaagcttttaaacgctctaataatggcgtttacatttccacgacaaaagttaagagtctttcgatgataagaggtccaccgcgtgctgaattaaatggcgtagtggtggacaaggttggagacacagattgtgtgttttattttgctgtgcgtaaagagggtcaggatgtcatcttcagccaattcgacagcctgagagtcagctctaaccagagcccacaaggtaatctggggagtaatgaacccggtaatgtcggtggtaatgatgctctggcaacctccactatctttacacaaagccgtgttattagctcttttacatgtcgtactgatatggaaaaagattttatagctttagatcaagatgtgtttattcagaagtatggtttggaggactatgcctttgaacacattgtttatggtaatttcaaccagaagattattggtggtttgcatttgttaataggcttgtaccgaagacagcaaacttccaatctggttattcaggagtttgtttcatacgactccagcatacactcttattttatcactgatgagaagagtggtggtagtaagagtgtttgcactgttatagatattttgttggatgattttgtggctcttgtcaagtcacttaatcttaactgtgtgagtaaggttgttaatgttaatgttgattttaaagattttcagttcatgctttggtgtaacgatgagaaagttatgactttctatcctcgtttgcaagctgcatctgactggaagcctggttattctatgcctgtattatataagtatttgaattccccaatggaaagagttagtctctggaattatgggaagccagttactttgcctacaggctgtatgatgaatgttgctaagtatactcagttatgtcaatatctgaatactacaacattagctgtacctgttaatacgcgagttttgcatttaggtgcaggttcagaaaaaggagtagcaccgggttctgcagttcttaggcagtggttgcctgctggtactattcttaggcagtggttgcctgctggtactattcttgtacataatgatttatacccatttgtgagtgacagtgtcgctacatattttggggattgtataaccttaccctttgattgtcaatgggatttgataatctctgatatgtatgacctattactagacataggagtacatgtagtaagatgttcttacatacattgtcatatgattcgcgacaagttagctctgggtggcagtgttgctataaaaataacagagttttcttggaatgcagaattatataagttaatggggtattttgcattttggacggttttctgcacaaatgcaaatgcttcttctagtgaagggtttttaattggcataaattatttgggtaagcccaaggttgagatagatggaaatgttatgcatgcaattatttgttttggagaaattccacagtttggaacgggggtgcttatagcctgtttgatatggctaaattcccgcttaagttggctggtaatgccgtaataaatttaagagcagaccagattaatgatatggtttattcccttcttgaaaagggtaaactacttgttagagatacaaataaagaagtttttgttggtgacagtatggttaatgtaatctaaactttaagaatggcagttgcttatgcagacaagcctaatcactttattaattttccacttacccagtttgagggttttgtgttaaattataaaggtttacaatttcaacttctcgatgaaggagtggattgtaaaatacaaacagcgccgcacattagtcttgctatgctgatattcagcctgaagactatagaagtgttgatgttgctattcaagaaggttattgatgacatgcattggggtgagggctttcagattaaatttgataacccccatatcctaggaagatgcatagttttagatgttaaaggtgtagaagaattgcatgatgatttagttaattacattcgtgataaaggttgtgttgctgaccaatccaggaaatggattggacattgcaccatagcccaactcacggatgctgcactttccattaaggaaaatgttgatttcataaacagcatgcaattcaattataaaatcactatcaacccctcatcaccggctagacttgaaatagttaagcttggtgctgaaaagaaagatggtttttatgaaaccatagttagccactggatgggaagtcgttttgaatataatccacccactgataagctagctatgattatgggttattgttgttcagaagtggtgcgtaaagagctagaagaaggtgatcttcccgagaatgatgatgatgcttggtttaagctatcgtaccattatgaaaacaattcttggttctttcgacatgtctacaggaaagttcttatttccgtaagtcttgtaaatttagattgtaattgtttggggttttatgaatctccagttgaagaagactaaactcagtgaaaatgtttttgcttcttagatttgttctagttagctgcataattggtagcctaggttttgataaccctcctaccaatgttgtttcgcatttaaatggagattggtttttatttggtgacagtcgttcagattgtaatcatgttgttaataccaacccccgtaattattcttatatggaccttaatcctgccctgtgtgattctggtaaaatatcatctaaagctggcaactccatttttaggagttttcactttaccgatttttataattacacaggcgaaggtcaacaaattattttttatgagggtcttaattttacgccttatcatgcctttaaatgcaccacttctggtagtaatgatatttggatgcagaataaaggcttgttttacactcaggtttataagaatatggctgtgtatcgcagccttacttttgttaatgtaccatatgtttataatggctctgcacaatctacagctctttgtaaatctggtagtttagttcttaataaccctgcatatatagctcgtgaagctaattttggggattattattataaggttgaagctgacttttatttgtcaggttgtgacgagtatatcgtaccactttgtatttttaacggcaagtttttgtcgaatacaaagtattatgatgatagtcaatattattttaataaagacactggtgttatttatggtctcaattctactgaaaccattaccactggttttgattttaattgtcattatttagttttaccctctggtaattatttagccatttcaaatgagctattgttaactgttcctacgaaagcaatctgtcttaacaagcgtaaggattttacgcctgtacaggttgttgattcacggtggaacaatgccaggcagtctgataacatgacggcggttgcttgtcaacccccgtactgttattttcgtaattctactaccaactatgttggtgtttatgatatcaatcatggggatgctggttttactagcatactcagtggtttgttatatgattcaccttgtttttcgcagcaaggtgtttttaggtatgataatgttagcagtgtctggcctctctattcctatggcagatgccctactgctgctgatattaatacccctgatgtacctatttgtgtgtatgatccgctaccacttattttgcttggcatccttttgggtgttgcggtcataattattgtagttttgttgttatattttatggtggataatggtactaggctgcatgatgcttagaccataatctaaacatgtttttgatacttttaatttccttaccaatggcttttgctgttataggagatttaaagtgtactacggtttccattaatgatgttgacaccggtgctccctctattagcactgatattgtcgatgttactaatggtttaggtacttattatgttttagatcgtgtgtatttaaatactacgttgttgcttaatggttactaccctacttcaggttctacatatcgtaatatggcactgaagggaactttactattgagcagactatggtttaaaccaccttttctttctgattttattaatggtatttttgctaaggtcaaaaataccaaggttattaaaaagggtgtaatgtatagtgagtttcctgctataactataggtagtacttttgtaaatacatcctatagtgtggtagtacaaccacatactaccaatttggataataaattacaaggtctcttagagatctctgtttgccagtatactatgtgcgagtacccacatacgatttgtcatcctaagctgggtaataaacgcgtagaactatggcattgggatacaggtgttgtttcctgtttatataagcgtaatttcacatatgatgtgaatgctgattacttgtatttccatttttatcaagaaggtggtactttttatgcatattttacagacactggtgttgttactaagtttctgtttaatgtttatttaggcacggtgctttcacattattatgtcctgcctttgacttgttctagtgctatgactttagaatattgggttacacctctcacttctaaacaatatttactagctttcaatcaagatggtgttatttttaatgctgttgattgtaagagtgattttatgagtgagattaagtgtaaaacactatctatagcaccatctactggtgtttatgaattaaacggttacactgttcagccaattgcagatgtttaccgacgtatacctaatcttcccgattgtaatatagaggcttggcttaatgataagtcggtgccctctccattaaattgggaacgtaagaccttttcaaattgtaattttaatatgagcagcctgatgtcttttattcaggcagactcatttacttgtaataatattgatgctgctaagatatatggtatgtgtttttccagcataactatagataagtttgctatacccaatggtaggaaggttgacctacaattgggcaatttgggctatttgcagtcttttaactatagaattgatactactgctacaagttgtcagttgtattataatttacctgctgctaatgtttctgttagcaggtttaatccttctacttggaataggagatttggttttacagaacaatttgtttttaagcctcaacctgtaggtgtttttactcatcatgatgttgtttatgcacaacattgttttaaagctcccaaaaatttctgtccgtgtaaattggatgggtctttgtgtgtaggtaatggtcctggtatagatgctggttataaaaatagtggtataggcacttgtcctgcaggtactaattatttaacttgccataatgctgcccaatgtgattgtttgtgcactcccgaccccattacatctaaatctacagggccttacaagtgcccccaaactaaatacttagttggcataggtgagcactgttcgggtcttgctattaaaagtgattattgtggaggtaatccttgtacttgccaaccacaagcatttttgggttggtctgttgactcttgtttacaaggggataggtgtaatatttttgctaattttatttttcatgatgttaatagtggtactacttgttctactgatttacaaaaatcaaacacagacataattcttggtgtttgtgttaattatgatctttatggtattacaggccaaggtatttttgttgaggttaatgcgacttattataatagttggcagaaccttttatatgattctaatggtaatctctatggttttagagactacttaacaaacagaacttttatgattcgtagttgctatagcggtcgtgtttcagcggcctttcatgctaactcttccgaaccagcattgctatttcggaatattaaatgcaattacgtttttaataatactctttcacgacagctgcaacctattaactattttgatagttatcttggttgtgttgtcaatgctgataatagtacttctagtgttgttcaaacatgtgatctcacagtaggtagtggttactgtgtggattactctacaaaaagacgaagtcgtagagcgattaccactggttatcggtttactaattttgagccatttactgttaattcagtaaatgatagtttagaacctgtaggtggtttgtatgaaattcaaataccttcagagtttactataggtaatatggaggagtttattcaaacaagctctcctaaagttactattgattgttctgcttttgtctgtggtgattatgcagcatgtaaatcacagttggttgaatatggtagcttctgtgacaatattaatgctatactcacagaagtaaatgaactacttgacactacacagttgcaagtagctaatagtttaatgaatggtgtcactcttagcactaagcttaaagatggcgttaatttcaatgtagacgacatcaatttttcccctgtattaggttgtttaggaagcgcttgtaataaagtttccagcagatctgctatagaggatttacttttttctaaagtaaagttatctgatgtcggtttcgttgaggcttataataattgtactggaggtgccgaaattagggacctcatttgtgtgcaaagttataatggtatcaaagtgttgcctccactgctctcagtaaatcagatcagtggatacactttggctgccacctctgctagtctgtttcctcctttgtcagcagcagtaggtgtaccattttatttaaatgttcagtatcgtattaatgggattggtgttaccatggatgtgttaagtcaaaatcaaaagcttattgctaatgcatttaacaatgctcttgatgctattcaggaagggtttgatgctaccaattctgctttagttaaaattcaagctgttgttaatgcaaatgctgaagctcttaataacttattgcaacaactctctaatagatttggtgctataagttcttctttacaagaaattctatctagactggatgctcttgaagcgcaagctcagatagacagacttattaatgggcgtcttaccgctcttaatgtttatgtttctcaacagcttagtgattctacactagtaaaatttagtgcagcacaagctatggagaaggttaatgaatgtgtcaaaagccaatcatctaggataaatttttgtggtaatggtaatcatattatatcattagtgcagaatgctccatatggtttgtattttatccactttagctatgtccctactaagtatgtcactgcgaaggttagtcccggtctgtgcattgctggtgatagaggtatagcccctaagagtggttattttgttaatgtaaataatacttggatgttcactggtagtggttattactaccctgaacccataactggaaataatgttgttgttatgagtacctgtgctgttaactatactaaagcgccggatgtaatgctgaacatttcaacacccaacctccatgattttaaggaagagttggatcaatggtttaaaaaccaaacatcagtggcaccagatttgtcacttgattatataaatgttacattcttggacctacaagatgaaatgaataggttacaggaggcaataaaagttttaaatcagagctacatcaatctcaaggacattggtacatatgagtattatgtaaaatggccttggtatgtatggcttttaattggctttgctggtgtagctatgcttgttttactattcttcatatgctgttgtacaggatgtgggactagttgttttaagatatgtggtggttgttgtgatgattatactggacaccaggagttagtaattaaaacatcacatgacgactaagttcgtctttgatttattggctcctgacgatatattacatcccttcaatcatgtgaagctaattataagacccattgaggtcgagcatattataatagctaccacaatgcctgctgtttagtgggtactgtgtcttatataactagtaaacctgtaatccaatggctacaaccattgacggtacagattatactaatattatgcctagtactgtttctacaagagtttatttaggctgttctataggtattgacactagcaccactggttttacctgtttttcatggtactagttccaaaccatattataatttaggtagaccttataactttaagcattattaattgccaaagtttctaaggtcacgccctagtaatggacatctggagacctgagattaaatatctccgttatactaacggttttaatgtctcagaattagaagatgcttgttttaaatttaactataaatttcctaaagtaggatattgtagagttcctagtcatgtttggtgccgtaatcaaggtagcttttgtgctacactcactctttatggcaaatccaaacattatgataaatattttggagtaataactggttttacagcattcgctaatactgctagaggaggctgttaacaaactggttttcttagctgttactttattacctgcggagacaggagttaaatgtttatggctgatgcttattttgcagacactgtgtggtatgtggggcaaataatttttatagttgccatttgtttattggttataatagttgtagtggcatttttggcaacttttaaattgtgtattcaactttgcggtatgtgtaataccttagtactgtccccttctatttatgtgtttaatagaggtaggcagttttatgagttttacaacgatgtaaaaccaccagttcttgatgtggatgacgtttagttaatccaaacattatgagtagtgtaactacaccagcaccagtttacacctggactgctgatgaagctattaaattcctaaaggaatggaacttttctttgggtattatactactttttattacaatcatattgcaatttggatatacaagtcgcagtatgtttgtttatgttattaagatgatcattttgtggcttatgtggccccttactatcatcttaactattttcaattgcgtgtatgcgttgaataatgtgtatcttggcttttctatagttttcactatagtggccattatcatgtggattgtgtattttgtgaatagtatcaggttgtttattagaactggaagttggtggagtttcaacccagaaacaaacaacttgatgtgtatagatatgaagggaaggatgtatgttaggccgataattgaggactaccatacccttacggtcacaataatacgtggtcatctttacatgcaaggtataaaactaggtactggctattctttgtcagatttgccagcttatgtgactgttgctaaggtctcacacctgctcacgtataagcgtggttttcttgacaagataggcgatactagtggttttgctgtttatgttaagtccaaagtcggtaattaccgactgccatcaacccaaaagggttctggcatggacaccgcattgttgagaaataatatctaaactttaaggatgtcttttactcctggtaagcaatccagtagtagagcgtcctttggaaatcgttctggtaatggcatccttaagtgggccgatcagtccgaccaatctagaaatgttcaaaccaggggtagaagagctcaacccaagcaaactgctacttctcagctaccatcaggagggaatgttgtaccctactattcttggttctctggaattactcagtttcaaaaaggaaaggagtttgaatttgcagagggacaaggtgtgcctattgcaccaggagtcccagctactgaagctaaggggtactggtacagacacaacagacgttcttttaaaacagccgatggcaaccagcgtcaactgctgccacgatggtatttttactatcttggaacaggaccgcatgccaaagaccagtatggcaccgatattgacggagtcttctgggtcgctagtaaccaggctgatgtcaataccccggctgacattctcgatcgggacccaagtagcgatgaggctattccgactaggtttccgcctggcacggtactccctcagggttactatattgaaggctcaggaaggtctgctcctaattccagatctacttcacgcgcatccagtagagcctctagtgcaggatcgcgtagtagagccaattctggcaacagaacccctacctctggtgtaacacctgatatggctgatcaaattgctagtcttgttctggcaaaacttggcaaggatgccactaagccacagcaagtaactaagcagactgccaaagaaatcagacagaaaattttgaataagccccgccagaagaggagccccaataaacaatgcactgttcagcagtgttttgggaagagaggccccaatcagaattttggtggtggagaaatgttaaaacttggaactagtgacccacagttccccattcttgcagaactcgcacccacagctggtgcgtttttctttggatcaagattagagttggccaaagtgcagaatttgtctgggaatcttgacgagccccagaaggatgtttatgaattgcgctataatggtgcaattagatttgacagtacactttcaggttttgagaccataatgaaggtgttgaatgagaatttgaatgcatatcaacaacaagatggtatgatgaatatgagtccaaaaccacagcgtcagcgtggtcagaagaatggacaaggagaaaatgataatataagtgttgcagcgcctaaaagccgtgtgcagcaaaataagagtagagagttgactgcagaggacatcagccttcttaagaagatggatgagccctatactgaagacacctcagaaatataagagaatgaaccttatgtcggcacctggtggtaagccctcgcaggaaagtcgggataaggcactctctatcagaatggatgtcttgctgctataatagatagagaaggttatagcagactatagattaattagttgaaagttttgtgtggtaatgtatagtgttggagaaagtgaaagacttgcggaagtaattgccgacaagtgcccaagggaagagccagcatgttaagttaccacccagtaattagtaaatgaatgaagttaattatggccaattggaagaatcacaaaaaaaaaaaaaaaaaaaaaaaaaaaaaaaaaaaaaaaaaaaaaaaaaaaaaaaaa

SEQ ID NO: 25 - DNA, 922 bp, Coronavirus
atttaataaatttggaaaagccaggctctattatgaagcattatcatttgaggagcaggatgaaatttacgcctatactaagcgcaatgtcctgccaacacttactcaaatgaatttgaaatatgctattagtgctaagaatagagcccgcactgttgctggtgtttccatactcagtactatgactggcagaatgtttcatcaaaaatgtttgaaaagtatagcagctacacgtggtgttcctgttgttataggcaccactaagttttatggcggctgggatgatatgttacgtcgccttattaaagatgttgataatcctgtacttatgggttgggattatcctaagtgtgatcgtgctatgccaaacatactacgtattgttagtagtctggtcttggcccgaaaacatgaggcatgttgttcgcaaagcgataggttttatcgacttgcgaatgaatgcgcacaagttctgagtgaaattgttatgtgtggtggctgttattatgttaagcctggtggcactagtagtggtgatgcaactactgcttttgctaattcagtttttaacatatgtcaagctgtttcagccaatgtatgtgctttaatgtcatgcaatggtaataagattgaagatttgagtatacgtgctcttcagaagcgcttatactcacatgtgtatagaagtgatatggttgattcaacctttgtcacagaatattatgaatttttaaataagcattttagtatgatgattctgagtgatgatggcgttgtgtgttataattctgattatgcgtccaaagggtatattgctaatataagtgcctttcaacaggtattgtattatcaaaataacgtttttatgtcagaatccaaatgttgggttgaaaatgacataaacaatggacctcatgaattc

SEQ ID NO: 26 - DNA, 31028 bp, Coronavirus; identical to SEQ ID NO: 21

SEQ ID NO: 27 - DNA, 922 bp, Coronavirus
tttgaacaaatttggtaaagctagactttactatgaaactctgtcatatgaagagcaggatgcactttttgctttaacaaagagaaatgttctacccacaatgactcagatgaatttgaaatatgctatttctggaaaggctagagctcgtacagtaggaggagtttcacttctttctaccatgactacgagacaataccaccagaagcatttgaagtcaattgctgcaacacgcaatgccactgtggttattggctcaaccaagttttatggtggttgggataacatgcttaaaaatttaatgcgtgatgttgataatggttgtttgatgggatgggactatcctaagtgtgaccgcgctttacctaatatgatcagaatggcatctgccatgatattaggttctaagcatgttggttgttgtacacatagtgatagattctatcgcctctccaatgagttagctcaagtactcacagaagttgtgcattgcacgggtggtttttactttaaacctggtggtacaactagcggtgatggtactacggcttatgctaactcagcttttaacatctttcaagctgtttctgctaatgttaataagcttttgggagtcgattcaaacgcttgtaacaatgttacagtaaaatccatacaacgtaaaatctacgataattgttatcgtagtagcagcattgatgaagaatttgttgttgaatacttcagttatttgagaaaacacttttctatgatgattctatctgatgatggagttgtgtgctacaacaaagattatgcagatctaggttatgtagctgatatcaatgcttttaaagcaacgctctattatcagaataatgtctttatgtccacttctaagtgttgggtagaaccagatcttaatgttggaccacatgaattt

SEQ ID NO: 28 - DNA, 251 bp, Coronavirus
actcagatgaatttgaaatatgctattagtgctaagaatagagcccgcactgttgctggtgtttccatacttagtactatgactggcagaatgtttcatcaaaaatgtttgaaaagtatagcagctacacgtggtgttcctgttgttataggcaccactaaattttatggcggctgggatgatatgttacgtcgccttattaaagatgttgacaatcctgtacttatgggttgggattatcctaagtgtga

SEQ ID NO: 29 - DNA, 922 bp, Coronavirus
tttgaacaaatttggtaaagctagactttactacgaaactctttcatatgaagagcaggatgcactttttgctttaacaaagagaaatgttctacccacaatgactcaaatgaatttgaaatatgctatttctggtaaggcaagagctcgtacagtaggaggagtttcacttctttctaccatgactacgagacaataccatcagaagcatttgaagtcaattgctgcaacacgcaatgccactgttgtcattggttcaaccaagttttatggtggttgggacaacatgcttaaaaatttgatgcgtgatgttgataacggttgtttgatggggtgggactatcctaagtgtgaccgtgctttacctaatatgattagaatggcttctgccatgatattgggttctaagcatgttggttgttgtacacatagtgatagattctaccgcctctccaacgagttagctcaagtactcacagaagttgtgcattgcacaggcggtttttactttaaacctggtggtacaactagtggtgatggtactacagcttacgctaactctgcttttaacatctttcaagctgtttctgctaatgttaataagcttttgggcgttgattcaaacgcttgtaacaatgttacagtaaagtccatacaacgtaaaatctacgataattgttatcgtagtagcagcattgatgaagaatttgttgttgagtactttagttatttgagaaaacacttttctatgatgattttatctgatgatggagttgtgtgctacaacaaagattatgcagatctaggttatgtagctgacattaatgcttttaaagcaacgctctattatcagaataatgtcttcatgtccacttctaagtgttgggtagaaccagatcttagcgttggaccacatgaattt

SEQ ID NO: 30 - DNA, 27317 bp, Coronavirus
acttaagtaccttatctatctacagatagaaaagttgctttttagactttgtgtctacttttctcaactaaacgaaatttttgctatggccggcatctttgatgctggagtcgtagtgtaattgaaatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctaatggcctgcaaccgtgtgacacttgccgtagcaagtgattctgaaatttctgcaaatggctgttctactattgcgcaagccgtccgccgttatagcgaggccgctagcaatggttttagggcatgccgatttgtttcattagatttgcaggattgcatcgttggcattgcagacgatacatatgttatgggtctgcatggcaatcagacgttgttttgcaacataatgaaattttctgaccgtccttttatgcttcatgggtggttggttttttccaattcaaattaccttttggaggaatttgatgttgtcttcggtaagagaggtggtggtaatgtgacatacactgaccagtatctctgtggcgccgatggcaaacctgttatgagtgaagatttatggcagtttgttgaccatttcggtgagaacgaagaaattatcatcaatggtcatacttacgtttgtgcttggcttactaagcgtaagcccttagattacaaacgtcagaacaaccttgccattgaagagattgaatatgtgcatggtgatgctttgcatacactacgcaatggttctgttcttgaaatggctaaggaagtgaagacatctagtaaagttgtgttaagcgatgctcttgacaaactttacaaagtctttggttctcctgttatgacaaatggttccaacatcctagaggcctttactaaacctgtgtttattagtgcattagttcaatgtacttgtggtaccaagtcttggtctgttggtgattggaccggttttaaatcctcttgttgcaacgtgatcagtaataaactgtgtgttgttcccggtaatgttaaacctggtgatgctgtgattaccactcagcaagctggtgctggtattaagtatttttgtggcatgactcttaagtttgttgcaaatattgaaggtgtctctgtttggagagtgattgctcttcagagtgtggattgctttgttgcttcttccacttttgtagaagaggaacatgttaatagaatggatacattctgcttcaatgtacgcaatagtgttactgatgagtgtcgtctggccatgttgggtgctgaaatgactagtaatgtcagaagacaagttgcttcaggtgtcatagacattagtaccggttggtttgatgtttatgatgacatctttgctgaaagcaaaccatggtttgttcgcaaggctgaagacatttttggcccttgttggtccgctcttgcttctgcacttaaacaacttaaagtcactacaggtgaacttgtgagatttgttaagtctatttgcaattcagctgttgctgtcgtgggtggtactatacaaattctcgctagtgtgcctgagaagtttttgaatgcgtttgacgtgtttgtcacagctattcaaactgtctttgactgtgctgttgaaacttgtactattgccggtaaagcatttgacaaggtttttgactatgttttgcttgataatgcgcttgtaaaacttgtcaccacaaagcttaagggtgttcgtgaacgtggccttaataaagttaagtatgcaacagttgttgttggttccactgaagaagttaaatcttcacgtgttgaacgtagcactgctgtacttacaatcgccaacaattattccaaactttttgatgaagggtatactgttgtaattggcgatgtggcgtactttgttagtgacggctacttccgtcttatggccagtccaaatagtgtgttgactactgcagtctataaaccattgtttgcttttaatgtgaatgttatgggtactagacctgaaaaatttccaaccactgtgacttgtgaaaatttagagtctgctgttttgtttgttaatgacaaaattactgaattccaattggattacagtattgatgtcattgataatgaaataattgtcaaacctaatatcagcctatgtgttccactttatgtgagagactatgttgacaaatgggatgatttttgcagacaatatagtaacgagtcttggtttgaggatgattacagggcttttatcagtgttttggacatcactgatgctgctgtgaaagctgcagagtctaaagctttcgttgatactattgttccaccttgcccatctattttgaaagttatagatggaggcaaaatatggaatggtgttattaaaaatgttaactctgttagagactggcttaagtctttgaagttaaatctcacacaacagggtttgcttggaacatgtgcaaagcgttttaaacgttggcttggcattttgctagaggcctataatgcgtttttagacactgtggtttctactgttaaaattggtggcttgacctttaaaacatatgcttttgataaaccttacattgtgatacgtgatatcgtgtgtaaggttgaaaataaaacagaagcagaatggattgagctttttccacataatgacaggattaagtcttttagtactttcgagagtgcttacatgccaattgcagaccctacacattttgacattgaagaagttgaacttttagatgcagagtttgtagaaccaggctgtggtggtattttggcagtaatagatgagcacgtcttttataagaaggatggtgtttattatccatcaaatggtactaacattctacctgttgcatttacaaaagccgctggtggtaaagtttcattttctgatgacgttgaagtaaaagacattgaacctgtttacagagtcaagctttgctttgagtttgaagatgaaaaacttgtagatgtttgtgaaaaggcaattggcaagaaaattaaacatgaaggtgactgggatagcttttgtaagactattcaatcagcactttctgttgtttcttgctatgtaaatctacctacttattacatttatgatgaagaaggcggtaatgacttgagtttgcccgttatgatttctgaatggcctctttctgttcaacaagctcaacaagaagctactttacctgatattgctgaggatgttgttgaccaagttgaagaagtcaatagcatttttgacattgagacagtggatgttaaacatgatgtgagtccttttgaaatgccatttgaagagttaaatggtttaaagatactcaaacaattggataacaactgctgggttaactcagttatgttacaaatacaattaactggtatacttgatggtgactatgctatgcagttttttaaaatgggccgagttgccaagatgattgaacgctgctacactgctgagcaatgtatacgtggtgctatgggtgatgttggtttgtgtatgtatagactgcttaaagacttacacactggttttatggttatggattataaatgtagttgtaccagtggtaggcttgaagaatcgggagctgttttgttttgtacgcccactaagaaggcgtttccttatggtacttgtctaaattgtaacgcacctcgcatgtgtacaattaggcagttacaaggtaccataatatttgtgcaacaaaaaccagaacctgttaatcctgtttcttttgttgttaaaccagtctgctcatcaatttttcgtggtgctgtgtcttgtggtcattaccagactaacatctattcacaaaatttgtgtgtggatggttttggtgttaacaagattcagccctggacaaatgatgcacttaatactatttgtattaaggatgcagattataatgcaaaagttgaaatatctgttacaccaattaaaaatacagttgatacaacacctaaggaagaatttgttgttaaagagaagttgaacgccttcctcgttcatgacaatgtagctttctaccaaggtgatgttgatactgttgttaatggtgttgactttgactttattgtaaatgctgctaatgagaaccttgctcatggtggaggacttgccaaagctttagatgtgtacactaaaggtaaacttcaacgtttatctaaagaacacattggattagcgggtaaagtaaaagttggtacaggagttatggttgagtgtgatagccttagaatttttaatgttgttggtccacgcaagggtaaacatgaacgtgatttactcataaaagcttacaacactattaataatgaacaaggcacacctttaacaccaattttgagctgtggtatttttggtatcaaactcgaaacttcattagaagttttgcttgatgtttgtaatacaaaagaagttaaagtttttgtttatacagacacagaggtttgtaaggttaaggattttgtgtctggtttagtgaatgttcaaaaagttgagcaacctaaaatagaaccaaaaccagtgtccgtaattaaagttgcacccaagccttacagggtagatggtaaatttagttactttacagaagacttgttgtgtgtcgctgatgacaaacccattgttttgtttactgactctatgcttactttggatgaccgtggtttagctctagacaatgcacttagtggtgtgcttagtgctgctattaaggattgtgttgacataaataaagctataccttctggtaatcttattaagtttgatataggttctgttgttgtctacatgtgtgttgtgccatccgaaaaggacaaacatttagataataatgttcaacgatgcacacgtaagttgaatagacttatgtgtgatatagtttgtactataccagctgactacatcttgccattggtgttgtctagtttgacttgtaatgtttcttttgtaggtgaacttaaagctgctgaagctaaagttataactataaaggtgacagaggatggtgttaatgttcatgatgtgaccgtgacaacagacaagtcatttgaacaacaagttggtgttattgctgataaggacaaagatctttctggtgcagtaccaagtgatcttaacacatctgaattgcttactaaagcaatagatgttgattgggtcgaattttatggctttaaagatgctgttacttttgcaacagttgatcatagtgcttttgcctatgaaagtgctgttgttaatggtattagagtgttaaaaactagtgataataattgttgggtgaatgctgtttgtattgcactacagtattcgaaaccccattttatttcacaaggtcttgatgctgcgtggaataaatttgttttaggcgatgttgaaatttttgttgcatttgtttactatgttgcaagactaatgaaaggtgacaagggtgatgctgaagacactttgactaagttgtctaagtatcttgctaatgaagctcaagttcaattagaacattatagttcttgtgttgaatgtgatgctaaatttaaaaactctgttgcatctatcaattctgctatagtttgtgctagtgtcaaacgtgatggtgtgcaagttggttattgtgtccatggtattaagtactattcacgtgttagaagtgttagaggtagagctattatagtcagtgtcgaacagcttgaaccgtgtgctcagtctagacttttgagtggtgttgcttatactgctttttctggacctgttgacaaaggtcattatactgtttatgatactgcaaagaaatcaatgtatgatggtgatcgttttgttaaacatgatctttctctgctgtctgtcacatcagttgttatggttggtggttatgttgcacctgttaatacagtgaaacctaaaccagtcattaatcaacttgatgaaaaggcacagaagttctttgattttggtgattttttgattcataattttgttatttttttcacatggttattgagtatgtttactttgtgtaaaactgcagtaactacaggtgatgttaaaataatggccaaagcaccacaaaggacgggtgttgttttaaaacgtagtcttaaatataacttaaaagcgtcagcagctgttcttaaatctaagtggtggctgcttgctaagtttacgaaactactgttactcatatatacattgtactcagtagttttgctttgtgtacgttttggaccgtttaatttttgtagtgagactgttaatggttatgctaagtcaaactttgtcaaggatgattactgtgatggttcattgggctgcaagatgtgtctttttggttaccaagagttaagtcaatttagccatttggatgttgtgtggaagcatataacagaccctttgtttagtaatatgcaacctttcattgtcatggttttgctgcttatatttggtgacaattatttgagatgcttcttgctgtattttgttgctcagatgataagcacagttggtgtttttctaggttacaaggaaacaaattggttcttgcactttattccatttgatgttatttgtgatgaactgcttgtcactgttattgttattaaggttatttcttttgtcagacatgtgctttttggttgtgaaaacccagattgtattgcgtgttctaagagtgctagacttaagagattccctgttaacacaattgtcaatggtgtgcaacgttcattttatgttaatgcaaatggtggtagtaagttttgtaagaaacatagatttttctgtgttgattgtgactcttatggttatggcagcacgtttataacacccgaagtttctagagaacttggtaacattaccaaaacaaatgtgcaaccaacagggccggcctatgtcatgattgacaaagtggagtttgaaaatggtttttacagattgtattcctgtgaaacattttggcgttacaactttgatataactgaaagcaagtattcttgcaaagaggtttttaaaaattgtaatgttttggatgatttcatcgtgtttaacaataatgggaccaatgtaacgcaggttaaaaatgctagtgtttacttttcacagttgttgtgtaggcccattaaattagttgacagtgaacttttgtccactttgtcagttgattttaatggtgtcttacacaaggcatacattgatgtactacgtaatagctttggtaaagatcttaatgctaatatgtctttagccgagtgcaagagagctttaggcctgtctattagtgatcatgaatttactagtgctatttctaatgcacatcgttgtgacgtgttgttatctgatttgtcatttaacaactttgtcagttcgtatgctaaacctgaggaaaaattatcagcttatgacttggcgtgttgtatgcgtgcaggtgctaaggttgttaatgccaatgttctgacaaaggaccaaactcctattgtttggcatgcaaaggattttaacagtctttctgctgaaggtcgcaagtatattgtaaaaactagcaaagctaagggtttgactttcttgttgacaattaatgaaaaccaagctgtcacgcaaatacctgcaactagcattgttgctaagcaaggtgctggtgatgctggccattcattaacatggctgtggctactgtgtggtcttgtgtgtttgattcaattctacttgtgctttttcatgccctattttatgtacgatatcgtgagtagttttgagggttatgattttaagtatatagaaaatggtcagttgaagaattttgaagcgccacttaaatgcgtcagaaacgtttttgaaaactttgaggactggcattatgctaagtttggcttcacacctttaaacaagcaaagctgtcctattgtagttggagtttctgaaattgttaatactgtcgctggcattccatctaatgtgtatcttgttggtaaaactttaatttttacactacaagctgcttttggtaatgctggtgtttgttatgacatttttggagtcacaacacctgaaaagtgcatttttacttctgcttgtactagattagaaggtttgggtggtaacaatgtttattgttataacacagcgcttatggaaggttctttgccttacagttcaatacaagctaatgcatattataaatatgacaatggcaattttattaagttgccagaagttattgcacaaggctttggttttagaacagtgcgtactattgccaccaaatactgccgcgtaggtgaatgtgttgaatccaatgcaggtgtgtgttttggctttgacaagtggtttgttaacgatggacgtgttgccaatggttacgtttgtggtactggtttgtggaaccttgtatttaacatactttccatgttttcatcttcattctctgttgctgcaatgtcaggtcaaattttacttaattgtgcattaggtgcttttgctattttttgttgttttcttgtgacaaagtttagacgcatgtttggtgacctttctgtaggtgtttgcactgttgttgtggctgttttgcttaacaatgtctcttacattgtaactcagaatttagtaacaatgattgcttatgccatattgtatttctttgctactagaagcttacgctatgcatggatttggtgtgctgcatatttaattgcgtatatttcttttgctccatggtggttgtgtgcttggtactttcttgctatgttgacaggtttgttacctagtttgctgaagcttaaagtttcgacaaatcttttcgaaggtgacaaatttgtaggtacatttgaaagtgctgctgcaggaacatttgtcattgacatgcgttcttatgagaaacttgctaatagcatctctccagaaaagttgaaaagttatgctgctagctataatagatataagtactatagtggtaatgcaaatgaagctgattaccgttgcgcttgttatgcctatttagcaaaagcaatgttggacttttcgcgtgatcataatgacatcttgtacacacctccgactgtcagttatggttctacattacaggctggtttgcgcaaaatggcacaaccatctggctttgtggagaaatgtgttgtccgtgtctgctatggaaacactgtgttgaatgggttgtggcttggtgatattgtttattgcccacgtcatgttatcgcatctaacacaacttctgctatagattatgatcacgaatatagtattatgcggttgcataatttttctataatatctggtacagcatttcttggtgttgtaggtgctactatgcatggagtaactcttaaaattaaggtttcacagactaacatgcacacacctagacattcttttagaacactaaaatctggtgaaggttttaacatcttagcatgctatgatggttgtgctcaaggtgtttttggtgtgaacatgagaactaattggactatccgtggttcatttattaatggtgcgtgtggttcccctggctacaatcttaaaaatggcgaggtggaatttgtttatatgcatcaaattgaactcggaagtggtagccatgtaggttctagctttgatggtgttatgtatggtggttttgaagaccaacctaatcttcaagttgaatctgcaaaccagatgttaacagttaatgtggttgcatttctttatgctgctatattgaatggttgcacatggtggcttaaaggtgaaaaattgtttgtggagcattataatgagtgggcacaggctaatggtttcacagctatgaatggtgaagacgctttttccattcttgctgctaaaactggtgtctgtgtggaaagattacttcatgctattcaagttttgaataatggctttggtggtaaacaaattttgggttattctagtctcaatgatgagttcagtattaatgaagttgtcaaacaaatgtttggtgttaacctgcaaagtggtaaaaccactagtatgtttaaatccataagcttatttgctggcttctttgtcatgttctgggctgaattatttgtttataccaccactatttgggttaaccctggttttcttactccgtttatgattttgcttgttgctttgtcactctgtcttacatttgttgttaaacataaggttttgtttttgcaagtgtttttgttgccttcaattattgtggctgctattcaaaactgtgcttgggactaccatgttacaaaggtgttggcagagaagtttgattataatgtttctgttatgcaaatggacatccagggttttgttaacatttttatttgtctttttgttgcactgttgcatacttggcgctttgctaaagagcgttgtacacattggtgcacttatttgttctcactcattgctgttttatacactgcattgtatagttatgactacgttagtttgctggttatgctactttgtgcaatttctaatgaatggtatattggtgctattatttttagaatttgtcgttttggtgttgcatttttaccagtggaatacgtgtcttactttgatggtgttaaaactgtgctgttgttttacatgttgttaggctttgttagctgtatgtactatggtttgttgtactggattaacaggttctgtaagtgcacattaggtgtttatgatttctgtgttagtccagccgaatttaagtatatggttgctaatggtttgaatgcaccaaatggcccttttgatgcgctctttctgtcttttaaactaatgggtattggcggtcctagaaccattaaagtttctactgtacagtctaaattgactgatcttaagtgcacaaacgtcgttctaatgggcattttgtctaacatgaacatagcttctaattcaaaggagtgggcatattgtgttgaaatgcacaataaaataaacttgtgtgacgaccctgaaactgctcaagagttattgctggcgttgttggcctttttcttgtctaagcatagtgattttggtcttggtgatcttgtcgattcttattttgagaacgactccattttgcaaagtgttgcatcttcttttgttggtatgccatcttttgttgcatatgaaacagcaagacaagagtatgaaaatgctgttgcaaatggttcctcaccacaaataatcaaacaattgaagaaggctatgaatgttgcaaaagctgagtttgacagggaatcatctgttcaaaagaaaattaacagaatggctgaacaagctgctgcagctatgtacaaagaagcacgtgctgttaatagaaaatcaaaagttgttagtgccatgcatagtttactctttggcatgctccgacgtttggacatgtctagtgttgacactatccttaatatggcacgtaatggtgttgtccctctttccgttatccctgctacttctgcagccaggctcgtcgtcgtagtaccagatcatgattcatttgtgaaaatgatggtagatggttttgtgcactacgctggtgttgtttggacattacaggaagttaaggataatgatggtaagaatgtgcatcttaaagatgttacaaaggaaaaccaggaaatacttgtttggcctctgattttgacttgtgaacgtgtcgttaaattgcagaacaatgaaataatgccgggcaagatgaaggtcaaggccaccaaaggtgaaggtgatggaggcattactagtgaaggtaatgctctatacaacaatgaaggtggacgtgcattcatgtatgcatatgtgactacgaagcctggcatgaagtatgttaaatgggaacatgactctggtgtggttacagttgaattggaaccaccttgcagatttgttatagacacacctactggaccccaaattaagtatctttattttgttaagaatcttaacaatttaaggagaggtgctgttttgggttacattggtgccactgtgagattgcaagctggcaaacagactgagtttgtttcaaactcccatttattaacacattgttcttttgctgttgacccagctgcagcctatcttgatgctgttaaacaaggcgcaaaacctgttggcaattgtgtaaagatgttgactaatggttctggtagcggtcaggctattacttgtaccattgattccaacactacgcaggacacatatggtggcgcgtctgtttgtatttattgcagagcacatgttgcacatccaaccatggacggtttttgtcagtacaaaggcaagtgggtacaagtgcctataggtacaaatgaccctataagattttgtcttgaaaatactgtttgtaaagtttgtggttgttggcttaatcatggctgtacatgtgaccggactgctatccaaagttttgataacagttatttaaacgagtccggggctctagtgccgctcgactagagccctgtaatggtacagacatagattactgtgtccgtgcatttgacgtttacaataaagatgcgtcttttatcggaaaaaatctgaagtccaattgtgtgcgcttcaagaatgtagataaggatgacgcgttctatattgttaaacgttgcattaagtcagttatggaccacgagcagtccatgtataacttacttaaaggctgtaatgctgttgctaagcatgatttctttacttggcatgagggcagaaccatttatggtaatgttagtagacaggatcttactaaatacaccatgatggatttgtgcttcgctctgcgtaactttgatgaaaaagactgtgaagtttttaaggagatattggttcttactggttgttgtagtactgattactttgaaatgaagaattggtttgaccccatagaaaatgaggacatacaccgtgtgtatgctgctttaggtaaggtagttgcaaatgcaatgcttaagtgtgttgctttttgcgacgaaatggtgctcaaaggagttgttggtgttttgaccttagacaaccaagatcttaatgggaatttctatgacttcggtgactttgtattgtgtcctcctggaatgggaataccctactgcacgtcatactattcttatatgatgcctgttatgggtatgactaattgtttagctagtgagtgctttatgaaaagtgacatctttggtcaagacttcaaaacttttgatttgttgaaatatgatttcacagaacataaggaggttttgtttaacaagtactttaagtattggggacaggattatcatcctgattgtgttgattgccatgacgagatgtgtattttgcattgttcaaattttaacacactcttcgcaaccacaattccaaacacggcttttggacctctatgcagaaaagtgtttattgatggtgtacccgtagttgctactgctggttaccactttaaacaattaggacttgtgtggaacaaagatgttaacactcattctaccagacttactattactgaactcttacagtttgtgacagatccaacgcttatagttgcgtcatcgcctgccttggtggataaacgcactgtttgtttttctgtcgctgctttgagtacaggattaacatcccaaacagtaaaacctggccattttaataaggagttttatgacttcttacgttctcaggggtttttcgatgagggttcagaattaacattgaagcatttcttttttacacaaaagggtgatgctgcaattaaagattttgattattatcgttacaacagacctactatgctggatattggacaagctcgcgtagcatatcaagtggcagctcgctattttgactgttacgagggtggctgtattacatctagagaggttgttgttacaaaccttaataaaagcgctggttggccccttaataagtttggtaaagctggtttatattatgagtctattagttatgaggaacaagatgctattttttcattaacaaagcgtaatattctccctactatgactcagttaaatcttaaatacgccatatctggtaaggaacgcgcacgtacagtgggtggcgtctctttattagctactatgactacaagacagtttcatcagaaatgtctgaaatccatagtagctaccagaaatgccaccgttgttatcggcactaccaagttttatggcgggtgggataatatgttaaagaacctgatggccgatgttgatgatcctaaattgatgggatgggactatcctaagtgtgatagagctatgccctcaatgattcgtatgttgtcggctatgatcttaggttctaagcatgtcacatgttgtacggctagtgataaattttatagacttagtaatgagcttgctcaagttttgaccgaggttgtttattcaaatggtgggttttattttaaacctggtggtacaacttctggtgatgcaactacagcctacgccaattctgtctttaatatatttcaggctgtaagttctaacattaattgcgttttgagcgttaactcgtcaaattgcaataattttaatgttaagaagttacagagacaactttatgataattgctatagaaatagtaatgttgatgaatcttttgtggatgacttttatggttatttgcaaaagcatttttctatgatgattctttctgatgatagtgttgtgtgctataataaaacttatgctggacttggttacattgctgatattagtgcttttaaagccactttgtattatcagaatggtgtgtttatgagtacagctaagtgttggactgaggaagatctttctataggacctcatgaattttgctcacagcacactatgcagattgtagatgaaaatggtaagtattatctaccatatccagatcctagccgtattatttctgctggtgtttttgtggatgacatcactaagactgatgctgtcattcttttggaacgctatgtttctctggctatagatgcctacccattgtctaagcatcctaaacctgagtacaggaaggtgttttacgcattgttagactgggtcaaacatctcaacaagactcttaacgaaggtgttttggagtctttttctgttacacttttagatgaacatgagtctaagttttgggatgaaagcttttatgctagtatgtatgagaagtctacagtattacaagctgctggtctttgtgtagtatgtggttctcaaacagttctaagatgcggtgattgtttacgcagaccgatgttgtgcactaagtgcgcctatgatcatgtgtttggcactgatcataagttcattttagctattacaccatatgtgtgtaacacatctggctgcaatgtaaatgacgttacaaaactgtatcttggaggtttgaattattactgtgtagaccacaaaccacatctttcattcccactgtgttcagctggtaatgtctttggtttgtacaaaagttctgctttgggttccatggacattgatgtctttaacaaactttctacctctgattggtctgacattcgcgactacaagcttgctaatgatgcaaaagagtcactaaggttgtttgcagctgaaacggtcaaggctaaagaggaaagtgttaagtcatcatacgcttatgctaccctaaaggagattgtaggtcctaaggaacttttgctcttatgggaaagtggaaaagccaaaccaccgttaaaccgtaattctgtttttacatgcttccaaattacaaaagactccaagtttcaagttggtgagtttgtgtttgagaaagtagattacggttctgatacggttacttacaaatccactgctactactaagttagtaccaggtatgttgtttattttgacttctcataatgttgctccacttagagcgccaacaatggcaaaccaggagaaatattctaccatttacaagttgcacccatcatttaatgttagtgatgcttatgcaaatcttgtaccttattaccaacttattggcaaacagcgtataaccacaatacagggtcctcctggtagtggaaaatcgcattgttctattggtattggtgtgtattaccctggagcgaggatcgtgttcaccgcttgttctcacgctgctgttgattcgctctgtgcaaaagctgtcacagcctatagtgttgataagtgtacacgtattattcctgcacgtgccagagttgagtgttatagtggttttaaacctaacaataatagtgcacaatacgtgtttagtactgttaatgcgttacctgaagttaatgcagacattgttgtcgtggatgaggtgtctatgtgcactaactatgacttgtctgtgattaaccagcgtatatcatataaacacattgtatatgttggtgatcctcaacagcttccagctcctagagttcttatctctaaaggtgttatggaaccaattgactataatgttgtgacacaacgtatgtgtgctataggacccgatgtctttttacacaagtgttacagatgtcctgctgaaatagttaacactgtttcagagcttgtttatgaaaacaagtttgtacctgtcaaagaagctagtaagcagtgcttcaaaatctttgaacgcggtagtgttcaggtagacaatggctccagtataaataggcgtcaacttgatgttgttaagcgatttatacataaaaactccacatggagcaaggctgtgtttatctcaccttacaatagtcaaaattatgtagctgccaggcttttaggcttacaaactcagacagtggattctgctcaaggtagtgaatatgactatgttatattcgcacagacatcagatactgctcatgcctgtaatgccaatcgttttaacgttgccattactagagcaaagaaaggtattttctgtattatgtctgacagaactttgtttgatgcacttaagttctttgaaatcactatgacagatttacagtctgaaagtagttgtggtttgtttaaggattgtgcacgtaaccctattgatttaccaccaagtcatgccactacttatttgtcattgtctgatagatttaagactagtggtgacttggctgttcaaataggtaacaacaatgtttgtacctatgaacatgtgatttcatatatgggtttcaggtttgatgttagcatgcctggtagtcatagtttgttctgtactagagactttgccatgcgtcatgtcagaggttggttaggaatggatgtggaaggtgcacatgtcacaggtgacaatgttggcactaatgtacctctacaagttggtttttccaatggtgttgattttgtagctcaacctgaaggttgtgttctaacaaacactggcagtgttgtaaaacctgttcgtgctcgtgcaccacctggagaacaattcactcacattgtacctctgttacgcaagggacaaccttggagtgtgttgagaaaacgtattgttcaaatgatagcagattttcttgctggctcatctgatgtactggtgtttgtactttgggctggcggtttagagttgaccactatgcgttattttgttaagattggagctgttaaacattgccaatgtggtactgttgcaacatgctacaattctgttagtaatgactattgttgctttaaacatgcattgggctgtgactatgtttataatccatatgtcatagatattcaacaatggggttatgttggttcactctccactaatcaccatgcaatttgtaatgttcatagaaatgagcatgttgcttctggtgatgctattatgactagatgtttggctgtgtatgactgctttgttaagaatgtggattggtcaattacctaccctatgatagctaatgaaaatgccataaacaagggcggtcgcactgtgcagagtcatattatgcgtgctgctattaaattgtacaaccctaaagcaatccatgacattggtaatcctaagggtattcgttgtgctgtaactgatgccaagtggtattgttatgacaagaaccctattaattctaatgtgaaaacattggagtatgattacatgacacatggccaaatggatggcttgtgtttgttttggaattgtaatgtggatatgtaccctgaattctcaattgtttgcaggtttgacacacgtacacgatctacattgaaccttgaaggtgtaaatggtgggtcattgtatgtcaataatcatgcatttcacactcctgcttatgataaacgtgctatggctaaattgaaaccagcaccgtttttctactatgacgacggttcatgtgaggttgttcacgatcaagttaactatgttcctttgagagccactaattgcattaccaagtgtaatattggtggtgctgtatgttctaagcacgctaatctctatagagcatatgttgagtcatataacatttttactcaagctggttttaatatttgggttcctaccacgtttgattgttataatttgtggcagacattcacagaggtcaatttacaaggtttagagaacattgcttttaacgttgttaataaaggttcatttgttggtgctgatggtgaattaccagtagccattagtggtgataaagtgttcgtacgtgatggtaacactgataatttagtctttgttaacaaaacatcactgcctacaaacatagcatttgaactttttgctaagaggaaggttggtttaacaccacctctcagtattctcaaaaaccttggtgttgtcgccacatataagtttgtcttgtgggattatgaagctgagcgtcccttgacaagctttactaagtctgtttgtggttatacagactttgcagaggatgtttgtacttgttacgataatagtatacaaggttcatacgaacgttttactctgtcaactaatgctgtgttattctctgctactgctgtgaaaacaggtggtaagagtttgccggctattaaattgaattttggaatgcttaatggtaatgcaattgctactgtcaaatcagaagatggtaacataaaaaatattaactggtttgtttacgtacgcaaagatggcaaacctgttgatcattatgatggtttttatacccaaggtcgtaatttacaagactttttgcctcgcagcacaatggaagaagactttttgaacatggatataggcgtgtttattcaaaagtatggtctagaggatttcaacttcgagcacgttgtgtatggtgatgtttcaaaaactactctaggcggtttacacttgttgatttcacaagtacgtctgagtaaaatgggcatcttaaaggcagaggagtttgtggcagcatctgacataacactcaaatgttgtactgtgacttatcttaatgatcctagttctaagactgtttgtacttacatggatttgttgttggatgattttgtttctgtattgaagtctttggatttgactgttgtatccaaggttcatgaggtcataattgacaacaaaccatggagatggatgctatggtgtaaagataatgccgttgctacattctatcctcagttgcagagtgcagaatggaaatgcgggtattctatgcctggtatttataagacacaacgtatgtgcttagaaccatgtaatttgtataattatggtgcaggtttgaagttgcccagtggcattatgttcaatgttgttaaatacactcaattgtgtcaatattttaacagtaccacgttatgtgttcctcataatatgagagtgttacacttgggtgctggctctgattatggtgttgcaccaggaactgctgttcttaaaaggtggttgccgcacgacgcaattgttgttgacaacgatgttgttgactatgtgagtgacgctgattttagtgttactggtgattgtgcaaccgtttatttggaagacaagtttgacttgttaatctctgatatgtacgatggtaggacaaaggcaattgatggtgaaaatgtttcgaaagaaggatttttcacttacatcaatggtttcatttgtgaaaaacttgccatcggaggttcgattgctattaaagtaacagagtatagctggaataagaaattgtatgaacttgtacaaagattttctttttggactatgttttgcacttctgttaatacgtcatcatcagaagcctttgttgtcggaattaactatcttggtgatttcgcacaaggaccttttatagatggtaacataatacacgcaaattatgtattttggcgtaactccactgttatgagtttgtcctacaactctgttttagacctgagtaaatttaattgcaaacacaaagcgactgttgttgtgcaattaaaggatagtgatattaatgaaatggtgcttagtcttgttaggagtggtaagttgcttgtaaggggtaatggcaagtgtttgagttttagtaatcatttagtctcaactaaataaaatgtttgttttgcttgttgcatatgccttgttgcatattgctggttgtcaaactacaaatgggctgaacactagttactctgtttgcaacggctgtgttggttattcagaaaatgtatttgctgttgagagtggtggttatataccctccgactttgcattcaataattggttccttctaactaatacctcatctgttgtagatggtgttgtgaggagttttcagcctttgttgcttaattgcttatggtctgtttctggcttgcggtttactactggttttgtctattttaatggtactgggagaggtgattgtaaaggtttttcctcagatgttttgtctgatgtcatacgttacaacctcaattttgaagaaaaccttagacgtggaaccattttgtttaaaacatcttatggtgttgttgtgttttattgtaccaacaacactttagtttcaggtgatgctcacataccatttggtacagttttgggcaatttttattgctttgtaaatactactattggcaatgaaactacgtctgcttttgtgggtgcactacctaagacagttcgtgagtttgttatttcacgcacaggacatttttatattaatggctatcgctatttcactttaggtaatgtagaagccgttaatttcaatgtcactactgcagaaaccactgatttttgtactgttgcgttagcttcttatgctgacgttttggttaatgtgtcacaaacctctattgctaatataatttattgcaactctgttattaacagactgagatgtgaccagttgtcctttgatgtaccagatggtttttattctacaagccctattcaatccgttgagctacctgtgtctattgtgtcgctacctgtttatcataaacatacgtttattgtgttgtacgttgacttcaaacctcagagtggcggtggcaagtgctttaactgttatcctgctggtgttaatattacactggccaattttaatgaaactaaagggcctttgtgtgttgacacatcacacttcactaccaaatacgttgctgtttatgccaatgttggtaggtggagtgctagtattaacacgggaaattgccctttttcttttggcaaagttaataactttgttaaatttggcagtgtatgtttttcgctaaaggatatacccggtggttgcgcaatgcctatagtggctaattgggcttatagtaagtactatactataggctcattgtatgtttcttggagtgatggtgatggaattactggcgtcccacaacctgttgagggtgttagttcctttatgaatgttacattggacaaatgtactaaatataatatttatgatgtatctggtgtgggtgttattcgcgttagcaatgacacctttcttaatggaattacgtacacatcaacttcaggtaaccttctgggttttaaagatgttactaagggcaccatctactctatcactccttgtaacccaccagatcagcttgttgtttatcagcaagctgttgttggtgctatgttgtctgaaaattttactagttacggcttttctaatgttgtagaactgccgaaatttttctatgcgtccaatggcacttataattgcacagacgctgttttaacttattctagttttggcgtttgtgcagatggttctataattgctgttcaaccacgtaatgtttcatatgatagtgtttcagctatcgtcacagctaatttgtctataccttccaattggaccacttcggtccaggttgagtatttacaaattacaagtacacctatcgtagttgattgctccacttatgtttgcaatggtaatgtgcgctgtgttgaattgcttaagcagtatacttctgcttgtaaaactattgaagacgccttaagaaatagcgccaggctggagtctgcagatgttagtgagatgctcacttttgacaagaaagcgtttacacttgctaatgttagtagttttggtgactacaaccttagcagcgtcatacctagcttgcccacaagtggtagtagagtggctggtcgcagtgccatagaagacatactttttagcaaacttgttacttctggacttggcactgtggacgcagactacaaaaagtgcactaagggtctttccattgctgacttggcttgtgctcaatattataatggcattatggttttgcctggcgtcgctgatgctgaacgaatggccatgtatacaggttctttaattggtggaattgctttaggaggtctaacatcagccgtttcaataccattttcattagcaattcaggcacgtttaaattatgttgcattgcagactgatgttttacaagaaaatcagaaaattcttgctgcatcttttaacaaagcaatgaccaacatagtagatgcctttactggtgttaatgatgctattacacaaacttcacaagccctacaaacagttgctactgcacttaacaagatccaggatgttgttaatcaacaaggcaactcattgaaccatttaacttctcagttgaggcagaattttcaagctatctctagctctattcaggctatctatgacagacttgacactattcaggctgatcaacaagtagataggctgattactggtagattggctgctttgaatgtattcgtttctcatacattgactaagtacactgaagttcgtgcttccagacagcttgcacaacaaaaagtgaatgagtgtgtcaaatcccagtctaagcgttatggcttctgtggaaatggcactcacattttctcaattgttaatgctgctcctgaggggcttgtttttctccacactgtcttgttgccgacacaatataaggatgttgaagcgtggtctgggttgtgcgttgatggtacaaacggttatgtgttgcgacaacctaatcttgctctttacaaagaaggcaattattatagaatcacatctcgcataatgtttgaaccacgtattcctaccatggcagattttgttcaaattgaaaattgcaatgtcacatttgttaacatttctcgctctgagttgcaaaccattgtgccagagtatattgatgttaataagacgctgcaagaattaagttacaaattgccaaattacactgttccagacctagttgtcgaacagtacaaccagactattttgaatttgaccagtgaaattagcacccttgaaaataaatctgcggagcttaattacactgttcaaaaattgcaaactctgattgacaacataaatagcacattagtcgacttaaagtggctcaaccgggttgagacttacatcaagtggccgtggtgggtgtggttgtgcatttcagtcgtgctcatctttgtggtgagtatgttgctattatgttgttgttctactggttgctgtggcttctttagttgttttgcatcttctattagaggttgttgtgaatcaactaaacttccttattacgacgttgaaaagatccacatacagtaatggctctaggtttgttcacattgcaacttgtgtctgctgttaatcaatcgcttagcaatgcgaaagttagtgctgaagtttcacgacaggttatccaagacgtgaaagatggcactgttaccttcaacttgctagcgtatacactaatgagcctctttgttgtgtattttgctttatttaaagcaagatcacaccgtggcagagctgctcttatagtgtttaaaattctaatccttttcgtttatgtgccattgctgtattggtctcaagcatatatttacgcaactttgattgctgtaattttgcttggaagatttttccatacagcttggcactgctggctctacaagacatgggatttcattgtcttcaatgtaaccacactttgctatgcaaggtaagtgttggtttcttgaaaataaggctctgaaaccattcgtttgtttttacggaggggatcaattcctttacataggcgacagaattgtttcttatttctcaactaacgacttgtacgttgctcttagaggacgtattgataaagacctcagcctttctagaaaggttgagttatataacggtgaatgtgtatacttgttttgtgaacacccagctgttggaatagtcaacacagatttcaaattagaaatccactaagatgttccttaagctagtggatgatcatgctttggttgttaatgtactactctggtgtgtggtgcttatagtgatactactagtgtgtattacaataattaaactaattaagctttgtttcacttgccatatgttttgtaatagaacagtttatggccccattaaaaatgtgtaccacatttaccaatcatatatgcacatagaccctttccctaaacgagttattgatttctaaactaaacgacaatgtcaaatgacaattgtacgggtgacattgtcacccatttgaagaattggaattttggttggaatgttattctaaccatattcattgttattcttcagtttggacactataaatactccagattgttttatggtttgaagatgcttgtactgtggcttctttggccactcgtacttgctttgtcaatctttgacacctgggctaattgggattctaattgggcctttgttgcatttagcttttttatggccgtatcaacactcgttatgtgggtgatgtacttcgcaaacagtttcagacttttccgacgtgctcgaactttttgggcatggaatcctgaggttaatgcaatcactgtcacaaccgtgttgggacagacatactatcaacccattcaacaagctccaacaggcattactgtgaccttgctgagcggcgtgctttacgttgacggacatagattggcttcaggtgttcaggttcataacctacctgaatacatgacagttgccgtgccgagcactactataatttatagtagagtcggaaggtccgtaaattcacaaaatagcacaggctgggttttctacgtacgagtaaaacacggtgatttttctgcagtgagctctcccatgagcaacatgacagaaaacgaaagattgcttcattttttctaaactgaacgaaaagatggctacagtcaaatgggctgatgcatctgaaccacaacgtggtcgtcagggtagaataccttattctctttatagccctttgcttgttgatagtgaacaaccttggaaggtgatacctcgtaatttggtacccatcaacaagaaagacaaaaataagcttataggctattggaatgttcaaaaacgtttcagaactagaaagggcaaacgggtggatttgtcacccaagctgcatttttattatcttggcacaggaccccataaagatgcaaaatttagagagcgtgttgaaggtgtcgtctgggttgctgttgatggtgctaaaactgaacctacaggttacggtgttaggcgcaagaattcagaaccagagataccacacttcaatcaaaagctcccaaatggtgttactgttgttgaagaacctgactcccgtgctccttcccggtctcagtcgaggtcgcagagtcgcggtcgtggtgaatccaaacctcaatctcggaatccttcaagtgacagaaaccataacagtcaggatgacatcatgaaggcagttgctgcggctcttaaatctttaggttttgacaagcctcaggaaaaagataaaaagtcagcgaaaacgggtactcctaagccttctcgtaatcagagtcctgcttcttctcaaacttctgccaagagtcttgctcgttctcagagttctgaaacaaaagaacaaaagcatgaaatgcaaaagccacggtggaaaagacagcctaatgatgatgtgacatctaatgtcacacaatgttttggccccagagaccttgaccacaactttggaagtgcaggtgttgtggccaatggtgttaaagctaaaggctatccacaatttgctgagcttgtgccgtcaacagctgctatgctgtttgatagtcacattgtttccaaagagtcaggcaacactgtggtcttgactttcactactagagtgactgtgcccaaagaccatccacacttgggtaagtttcttgaggagttaaatgcattcactagagaaatgcaacaacatcctcttcttaaccctagtgcactagaattcaacccatctcaaacttcacctgcaactgctgaaccagtgcgtgatgaagtttctattgaaactgacataattgatgaagtaaactaaacatgccactgtgttgtttgaaattcaggctttagttggaattttgcttttgttctttcttttattatctttcttttgcctgtttttagagagatttggcgccttggtgccgtagatgaatacattgcttttctctgatctatgtatgatggtacgatcagagctgcttttaattaacatgatcccttgctttggcttgacaaggatctagtcttatacacaatggtaagccagtggtagtaaaggtataagaaatttgctactatgttactgaacctaggtgaacgctagtataactcattacaaatgtgctggagtaatcaaagatcgcattgacgagccaacaatggaagagccagtcatttgtcttgagacctatctagttagtaactgctaatggaacggtttcgatatggatacacaaaaaaaaaaaaaaaaaaaaaaaaaaaaaaaaaaaaaaaa

SEQ ID NO: 31 - DNA, 27317 bp, Coronavirus; identical to SEQ ID NO: 30

SEQ ID NO: 32 - DNA, 20580 bp, Coronavirus
acttaagtaccttatctatctacagatagaaaagttgctttttagactttgtgtctacttttctcaactaaacgaaatttttgctatggccggcatctttgatgctggagtcgtagtgtaattgaaatttcatttgggttgcaacagtttggaagcaagtgctgtgtgtcctagtctaagggtttcgtgttccgtcacgagattccattctacaaacgccttactcgaggttccgtctcgtgtttgtgtggaagcaaagttctgtctttgtggaaaccagtaactgttcctaatggcctgcaaccgtgtgacacttgccgtagcaagtgattctgaaatttctgcaaatggctgttctactattgcgcaagccgtccgccgttatagcgaggccgctagcaatggttttagggcatgccgatttgtttcattagatttgcaggattgcatcgttggcattgcagacgatacatatgttatgggtctgcatggcaatcagacgttgttttgcaacataatgaaattttctgaccgtccttttatgcttcatgggtggttggttttttccaattcaaattaccttttggaggaatttgatgttgtcttcggtaagagaggtggtggtaatgtgacatacactgaccagtatctctgtggcgccgatggcaaacctgttatgagtgaagatttatggcagtttgttgaccatttcggtgagaacgaagaaattatcatcaatggtcatacttacgtttgtgcttggcttactaagcgtaagcccttagattacaaacgtcagaacaaccttgccattgaagagattgaatatgtgcatggtgatgctttgcatacactacgcaatggttctgttcttgaaatggctaaggaagtgaagacatctagtaaagttgtgttaagcgatgctcttgacaaactttacaaagtctttggttctcctgttatgacaaatggttccaacatcctagaggcctttactaaacctgtgtttattagtgcattagttcaatgtacttgtggtaccaagtcttggtctgttggtgattggaccggttttaaatcctcttgttgcaacgtgatcagtaataaactgtgtgttgttcccggtaatgttaaacctggtgatgctgtgattaccactcagcaagctggtgctggtattaagtatttttgtggcatgactcttaagtttgttgcaaatattgaaggtgtctctgtttggagagtgattgctcttcagagtgtggattgctttgttgcttcttccacttttgtagaagaggaacatgttaatagaatggatacattctgcttcaatgtacgcaatagtgttactgatgagtgtcgtctggccatgttgggtgctgaaatgactagtaatgtcagaagacaagttgcttcaggtgtcatagacattagtaccggttggtttgatgtttatgatgacatctttgctgaaagcaaaccatggtttgttcgcaaggctgaagacatttttggcccttgttggtccgctcttgcttctgcacttaaacaacttaaagtcactacaggtgaacttgtgagatttgttaagtctatttgcaattcagctgttgctgtcgtgggtggtactatacaaattctcgctagtgtgcctgagaagtttttgaatgcgtttgacgtgtttgtcacagctattcaaactgtctttgactgtgctgttgaaacttgtactattgccggtaaagcatttgacaaggtttttgactatgtcttgcttgataatgcgcttgtaaaacttgtcaccacaaagcttaagggtgttcgtgaacgtggccttaataaagttaagtatgcaacagttgttgttggttccactgaagaagttaaatcttcacgtgttgaacgtagcactgctgtacttacaatcgccaacaattattccaaactttttgatgaagggtatactgttgtaattggcgatgtggcgtactttgttagtgacggctacttccgtcttatggccagtccaaatagtgtgttgactactgcagtctataaaccattgtttgcttttaatgtgaatgttatgggtactagacctgaaaaatttccaaccactgtgacttgtgaaaatttagagtctgctgttttgtttgttaatgacaaaattactgaattccaattggattacagtattgatgtcattgataatgaaataattgtcaaacctaatatcagcctatgtgttccactttatgtgagagactatgttgacaaatgggatgatttttgcagacaatatagtaacgagtcttggtttgaggatgattacagggcttttatcagtgttttggacatcactgatgctgctgtgaaagctgcagagtctaaagctttcgttgatactattgttccaccttgcccatctattttgaaagttatagatggaggcaaaatatggaatggtgttattaaaaatgttaactctgttagagactggcttaagtctttgaagttaaatctcacacaacagggtttgcttggaacatgtgcaaagcgttttaaacgttggcttggcattttgctagaggcctataatgcgtttttagacactgtggtttctactgttaaaattggtggcttgacctttaaaacatatgcttttgataaaccttacattgtgatacgtgatatcgtgtgtaaggttgaaaataaaacagaagcagaatggattgagctttttccacataatgacaggattaagtcttttagtactttcgagagtgcttacatgccaattgcagaccctacacattttgacattgaagaagttgaacttttagatgcagagtttgtagaaccaggctgtggtggtattttggcagtaatagatgagcacgtcttttataagaaggatggtgtttattatccatcaaatggtactaacattctacctgttgcatttacaaaagccgctggtggtaaagtttcattttctgatgacgttgaagtaaaagacattgaacctgtttacagagtcaagctttgctttgagtttgaagatgaaaaacttgtagatgtttgtgaaaaggcaattggcaagaaaattaaacatgaaggtgactgggatagcttttgtaagactattcaatcagcactttctgttgtttcttgctatgtaaatctacctacttattacatttatgatgaagaaggcggtaatgacttgagtttgcccgttatgatttctgaatggcctctttctgttcaacaagctcaacaagaagctactttacctgatattgctgaggatgttgttgaccaagttgaagaagtcaatagcatttttgacattgagacagtggatgttaaacatgatgtgagtccttttgaaatgccatttgaagagttaaatggtttaaagatactcaaacaattggataacaactgctgggttaactcagttatgttacaaatacaattaactggtatacttgatggtgactatgctatgcagttttttaaaatgggccgagttgccaagatgattgaacgctgctacactgctgagcaatgtatacgtggtgctatgggtgatgttggtttgtgtatgtatagactgcttaaagacttacacactggttttatggttatggattataaatgtagttgtaccagtggtaggcttgaagaatcgggagctgttttgttttgtacgcccactaagaaggcgtttccttatggtacttgtctaaattgtaacgcacctcgcatgtgtacaattaggcagttacaaggtaccataatatttgtgcaacaaaaaccagaacctgttaatcctgtttcttttgttgttaaaccagtctgctcatcaatttttcgtggtgctgtgtcttgtggtcattaccagactaacatctattcacaaaatttgtgtgtggatggttttggtgttaacaagattcagccctggacaaatgatgcacttaatactatttgtattaaggatgcagattataatgcaaaagttgaaatatctgttacaccaattaaaaatacagttgatacaacacctaaggaagaatttgttgttaaagagaagttgaacgccttcctcgttcatgacaatgtagctttctaccaaggtgatgttgatactgttgttaatggtgttgactttgactttattgtaaatgctgctaatgagaaccttgctcatggtggaggacttgccaaagctttagatgtgtacactaaaggtaaacttcaacgtttatctaaagaacacattggattagcgggtaaagtaaaagttggtacaggagttatggttgagtgtgatagccttagaatttttaatgttgttggtccacgcaagggtaaacatgaacgtgatttactcataaaagcttacaacactattaataatgaacaaggcacacctttaacaccaattttgagctgtggtatttttggtatcaaactcgaaacttcattagaagttttgcttgatgtttgtaatacaaaagaagttaaagtttttgtttatacagacacagaggtttgtaaggttaaggattttgtgtctggtttagtgaatgttcaaaaagttgagcaacctaaaatagaaccaaaaccagtgtccgtaattaaagttgcacccaagccttacagggtagatggtaaatttagttactttacagaagacttgttgtgtgtcgctgatgacaaacccattgttttgtttactgactctatgcttactttggatgaccgtggtttagctctagacaatgcacttagtggtgtgcttagtgctgctattaaggattgtgttgacataaataaagctataccttctggtaatcttattaagtttgatataggttctgttgttgtctacatgtgtgttgtgccatccgaaaaggacaaacatttagataataatgttcaacgatgcacacgtaagttgaatagacttatgtgtgatatagtttgtactataccagctgactacatcttgccattggtgttgtctagtttgacttgtaatgtttcttttgtaggtgaacttaaagctgctgaagctaaagttataactataaaggtgacagaggatggtgttaatgttcatgatgtgaccgtgacaacagacaagtcatttgaacaacaagttggtgttattgctgataaggacaaagatctttctggtgcagtaccaagtgatcttaacacatctgaattgcttactaaagcaatagatgttgattgggtcgaattttatggctttaaagatgctgttacttttgcaacagttgatcatagtgcttttgcctatgaaagtgctgttgttaatggtattagagtgttaaaaactagtgataataattgttgggtgaatgctgtttgtattgcactacagtattcgaaaccccattttatttcacaaggtcttgatgctgcgtggaataaatttgttttaggcgatgttgaaatttttgttgcatttgtttactatgttgcaagactaatgaaaggtgacaagggtgatgctgaagacactttgactaagttgtctaagtatcttgctaatgaagctcaagttcaattagaacattatagttcttgtgttgaatgtgatgctaaatttaaaaactctgttgcatctatcaattctgctatagtttgtgctagtgtcaaacgtgatggtgtgcaagttggttattgtgtccatggtattaagtactattcacgtgttagaagtgttagaggtagagctattatagtcagtgtcgaacagcttgaaccgtgtgctcagtctagacttttgagtggtgttgcttatactgctttttctggacctgttgacaaaggtcattatactgtttatgatactgcaaagaaatcaatgtatgatggtgatcgttttgttaaacatgatctttctctgctgtctgtcacatcagttgttatggttggtggttatgttgcacctgttaatacagtgaaacctaaaccagtcattaatcaacttgatgaaaaggcacagaagttctttgattttggtgattttttgattcataattttgttatttttttcacatggttattgagtatgtttactttgtgtaaaactgcagtaactacaggtgatgttaaaataatggccaaagcaccacaaaggacgggtgttgttttaaaacgtagtcttaaatataacttaaaagcgtcacaggctgttcttaaatctaagtggtggctgcttgctaagtttacgaaactactgttactcatatatacattgtactcagtagttttgctttgtgtacgttttggaccgtttaatttttgtagtgagactgttaatggttatgctaagtcaaactttgtcaaggatgattactgtgatggttcattgggctgcaagatgtgtctttttggttaccaagagttaagtcaatttagccatttggatgttgtgtggaagcatataacagaccctttgtttagtaatatgcaacctttcattgtcatggttttgctgcttatatttggtgacaattatttgagatgcttcttgctgtattttgttgctcagatgataagcacagttggtgtttttctaggttacaaggaaacaaattggttcttgcactttattccatttgatgttatttgtgatgaactgcttgtcactgttattgttattaaggttatttcttttgtcagacatgtgctttttggttgtgaaaacccagattgcattgcgtgttctaagagtgctagacttaagagattccctgttaacacaattgtcaatggtgtgcaacgttcattttatgttaatgcaaatggtggtagtaagttttgtaagaaacatagatttttctgtgttgattgtgactcttatggttatggcagcacgtttataacacccgaagtttctagagaacttggtaacattaccaaaacaaatgtgcaaccaacaggcccagcgtatgtcatgattgacaaagtggagtttgaaaatggtttttacagattgtattcctgtgaaacattttggcgttacaactttgatataactgaaagcaagtattcttgcaaagaggtttttaaaaattgtaatgttttggatgatttcatcgtgtttaacaataatgggaccaatgtaacgcaggttaaaaatgctagtgtttacttttcacagttgttgtgtaggcccattaaattagttgacagtgaacttttgtccactttgtcagttgattttaatggtgtcttacacaaggcatacattgatgtactacgtaatagctttggtaaagatcttaatgctaatatgtctttagccgagtgcaagagagctttaggcctgtctattagtgatcatgaatttactagtgctatttctaatgcacatcgttgtgacgtgttgttatctgatttgtcatttaacaactttgtcagttcgtatgctaaacctgaggaaaaattatcagcttatgacttggcgtgttgtatgcgtgcaggtgctaaggttgttaatgccaatgttctgacaaaggaccaaactcctattgtttggcatgcaaaggattttaacagtctttctgctgaaggtcgcaagtatattgtaaaaactagcaaagctaagggtttgactttcttgttgacaattaatgaaaaccaagctgtcacgcaaatacctgcaactagcattgttgctaagcaaggtgctggtgatgctggccattcattaacatggctgtggctactgtgtggtcttgtgtgtttgattcaattctacttgtgctttttcatgccctattttatgtacgatatcgtgagtagttttgagggttatgattttaagtatatagaaaatggtcagttgaagaattttgaagcgccacttaaatgcgtcagaaacgtttttgaaaactttgaggactggcattatgctaagtttggcttcacacctttaaacaagcaaagctgtcctattgtagttggagtttctgaaattgttaatactgtcgctggcattccatctaatgtgtatcttgttggtaaaactttaatttttacactacaagctgcttttggtaatgctggtgtttgttatgacatttttggagtcacaacacctgaaaagtgcatttttacttctgcttgtactagattagaaggtttgggtggtaacaatgtttattgttataacacagcgcttatggaaggttctttgccttacagttcaatacaagctaatgcatattataaatatgacaatggcaattttattaagttgccagaagttattgcacaaggctttggttttagaacagtgcgtactattgccaccaaatactgccgcgtaggtgaatgtgttgaatccaatgcaggtgtgtgttttggctttgacaagtggtttgttaacgatggacgtgttgccaatggttacgtttgtggtactggtttgtggaaccttgtatttaacatactttccatgttttcatcttcattctctgttgctgcaatgtcaggtcaaattttacttaattgtgcattaggtgcttttgctattttttgttgttttcttgtgacaaagtttagacgcatgtttggtgacctttctgtaggtgtttgcactgttgttgtggctgttttgcttaacaatgtctcttacattgtaactcagaatttagtaacaatgattgcttatgccatattgtatttctttgctactagaagcttacgctatgcatggatttggtgtgctgcatatttaattgcgtatatttcttttgctccatggtggttgtgtgcttggtactttcttgctatgttgacaggtttgttacctagtttgctgaagcttaaagtttcgacaaatcttttcgaaggtgacaaatttgtaggtacatttgaaagtgctgctgcaggaacatttgtcattgacatgcgttcttatgagaaacttgctaatagcatctctccagaaaagttgaaaagttatgctgctagctataatagatataagtactatagtggtaatgcaaatgaagctgattaccgttgcgcttgttatgcctatttagcaaaagcaatgttggacttttcgcgtgatcataatgacatcttgtacacacctccgactgtcagttatggttctacattacaggctggtttgcgcaaaatggcacaaccatctggctttgtggagaaatgtgttgtccgtgtctgctatggaaacactgtgttgaatgggttgtggcttggtgatattgtttattgcccacgtcatgttatcgcatctaacacaacttctgctatagattatgatcacgaatatagtattatgcggttgcataatttttctataatatctggtacagcatttcttggtgttgtaggtgctactatgcatggagtaactcttaaaattaaggtttcacagactaacatgcacacacctagacattcttttagaacactaaaatctggtgaaggttttaacatcttagcatgctatgatggttgtgctcaaggtgtttttggtgtgaacatgagaactaattggactatccgtggttcatttattaatggtgcgtgtggttcccctggctacaatcttaaaaatggcgaggtggaatttgtttatatgcatcaaattgaactcggaagtggtagccatgtaggttctagctttgatggtgttatgtatggtggttttgaagaccaacctaatcttcaagttgaatctgcaaaccagatgttaacagttaatgtggttgcatttctttatgctgctatattgaatggttgcacatggtggcttaaaggtgaaaaattgtttgtggagcattataatgagtgggcacaggctaatggtttcacagctatgaatggtgaagacgctttttccattcttgctgctaaaactggtgtctgtgtggaaagattacttcatgctattcaagttttgaataatggctttggtggtaaacaaattttgggttattctagtctcaatgatgagttcagtattaatgaagttgtcaaacaaatgtttggtgttaacctgcaaagtggtaaaaccactagtatgtttaaatccataagcttatttgctggcttctttgtcatgttctgggctgaattatttgtttataccaccactatttgggttaaccctggttttcttactccgtttatgattttgcttgttgctttgtcactctgtcttacatttgttgttaaacataaggttttgtttttgcaagtgtttttgttgccttcaattattgtggctgctattcaaaactgtgcttgggactaccatgttacaaaggtgttggcagagaagtttgattataatgtttctgttatgcaaatggacatccagggttttgttaacatttttatttgtctttttgttgcactgttgcatacttggcgctttgctaaagagcgttgtacacattggtgcacttatttgttctcactcattgctgttttatacactgcattgtatagttatgactacgttagtttgctggttatgctactttgtgcaatttctaatgaatggtatattggtgctattatttttagaatttgtcgttttggtgttgcatttttaccagtggaatacgtgtcttactttgatggtgttaaaactgtgctgttgttttacatgttgttaggctttgttagctgtatgtactatggtttgttgtactggattaacaggttctgtaagtgcacattaggtgtttatgatttctgtgttagtccagccgaatttaagtatatggttgctaatggtttgaatgcaccaaatggcccttttgatgcgctctttctgtcttttaaactaatgggtattggcggtcctagaaccattaaagtttctactgtacagtctaaattgactgatcttaagtgcacaaacgtcgttctaatgggcattttgtctaacatgaacatagcttctaattcaaaggagtgggcatattgtgttgaaatgcacaataaaataaacttgtgtgacgaccctgaaactgctcaagagttattgctggcgttgttggcctttttcttgtctaagcatagtgattttggtcttggtgatcttgtcgattcttattttgagaacgactccattttgcaaagtgttgcatcttcttttgttggtatgccatcttttgttgcatatgaaacagcaagacaagagtatgaaaatgctgttgcaaatggttcctcaccacaaataatcaaacaattgaagaaggctatgaatgttgcaaaagctgagtttgacagggaatcatctgttcaaaagaaaattaacagaatggctgaacaagctgctgcagctatgtacaaagaagcacgtgctgttaatagaaaatcaaaagttgttagtgccatgcatagtttactctttggcatgctccgacgtttggacatgtctagtgttgacactatccttaatatggcacgtaatggtgttgtccctctttccgttatccctgctacttctgcagccaggctcgtcgtcgtagtaccagatcatgattcatttgtgaaaatgatggtagatggttttgtgcactacgctggtgttgtttggacattacaggaagttaaggataatgatggtaagaatgtgcatcttaaagatgttacaaaggaaaaccaggaaatacttgtttggcctctgattttgacttgtgaacgtgtcgttaaattgcagaacaatgaaataatgccgggcaagatgaaggtcaaggccaccaaaggtgaaggtgatggaggcattactagtgaaggtaatgctctatacaacaatgaaggtggacgtgcattcatgtatgcatatgtgactacgaagcctggcatgaagtatgttaaatgggaacatgactctggtgtggttacagttgaattggaaccaccttgcagatttgttatagacacacctactggaccccaaattaagtatctttattttgttaagaatcttaacaatttaaggagaggtgctgttttgggttacattggtgccactgtgagattgcaagctggcaaacagactgagtttgtttcaaactcccatttattaacacattgttcttttgctgttgacccagctgcagcctatcttgatgctgttaaacaaggcgcaaaacctgttggcaattgtgtaaagatgttgactaatggttctggtagcggtcaggctattacttgtaccattgattccaacactacgcaggacacatatggtggcgcgtctgtttgtatttattgcagagcacatgttgcacatccaaccatggacggtttttgtcagtacaaaggcaagtgggtacaagtgcctataggtacaaatgaccctataagatcttgtcttgaaaatactgtttgtaaagtttgtggttgttggcttaatcatggctgtacatgtgaccggactgctatccaaagttttgataacagttatttaaacgagtccggggctctagtgccgctcgactagagccctgtaatggtacagacatagattactgtgtccgtgcatttgacgtttacaataaagatgcgtcttttatcggaaaaaatctgaagtccaattgtgtgcgcttcaagaatgtagataaggatgacgcgttctatattgttaaacgttgcattaagtcagttatggaccacgagcagtccatgtataacttacttaaaggctgtaatgctgttgctaagcatgatttctttacttggcatgagggcagaaccatttatggtaatgttagtagacaggatcttactaaatacaccatgatggatttgtgcttcgctctgcgtaactttgatgaaaaagactgtgaagtttttaaggagatattggttcttactggttgttgtagtactgattactttgaaatgaagaattggtttgaccccatagaaaatgaggacatacaccgtgtgtatgctgctttaggtaaggtagttgcaaatgcaatgcttaagtgtgttgctttttgcgacgaaatggtgctcaaaggagttgttggtgttttgaccttagacaaccaagatcttaatgggaatttctatgacttcggtgactttgtattgtgtcctcctggaatgggaataccctactgcacgtcatactattcttatatgatgcctgttatgggtatgactaattgtttagctagtgagtgctttatgaaaagtgacatctttggtcaagacttcaaaacttttgatttgttgaaatatgatttcacagaacataaggaggttttgtttaacaagtactttaagtattggggacaggattatcatcctgattgtgttgattgccatgacgagatgtgtattttgcattgttcaaattttaacacactcttcgcaaccacaattccaaacacggcttttggacctctatgcagaaaagtgtttattgatggtgtacccgtagttgctactgctggttaccactttaaacaattaggacttgtgtggaacaaagatgttaacactcattctaccagacttactattactgaactcttacagtttgtgacagatccaacgcttatagttgcgtcatcgcctgccttggtggataaacgcactgtttgtttttctgtcgctgctttgagtacaggattaacatcccaaacagtaaaacctggccattttaataaggagttttatgacttcttacgttctcaggggtttttcgatgagggttcagaattaacattgaagcatttcttttttacacaaaagggtgatgctgcaattaaagattttgattattatcgttacaacagacctactatgctggatattggacaagctcgcgtacgatatcaagtggcagctcgctattttgactgttacgagggtggctgtattacatctagagaggttgttgttacaaaccttaataaaagcgctggttggccccttaataagtttggtaaagctggtttatattatgagtctattagttatgaggaacaagatgctattttttcattaacaaagcgtaatattctccctactatgactcagttaaatcttaaatacgccatatctggtaaggaacgcgcacgtacagtgggtggcgtctctttattagctactatgactacaagacagtttcatcagaaatgtctgaaatccatagtagctaccagaaatgccaccgttgttatcggcactaccaagttttatggcgggtgggataatatgttaaagaacctgatggccgatgttgatgatcctaaattgatgggatgggactatcctaagtgtgatagagctatgccctcaatgattcgtatgttgtcggctatgatcttaggttctaagcatgtcacatgttgtacggctagtgctaaattttatagacttagtaatgagcttgctcaagttttgaccgaggttgtttattcaaatggtgggttttattttaaacctggtggtacaacttctggtgatgcaactacagcctacgccaattctgtctttaatatatttcaggctgtaagttctaacattaattgcgttttgagcgttaactcgtcaaattgcaataattttaatgttaagaagttacagagacaactttatgataattgctatagaaatagtaatgttgatgaatcttttgtggatgacttttatggttatttgcaaaagcatttttctatgatgattctttctgatgatagtgttgtgtgctataataaaacttatgctggacttggttacattgctgatattagtgcttttaaagccactttgtattatcagaatggtgtgtttatgagtacagctaagtgttggactgaggaagatctttctataggacctcatgaattttgctcacagcacactatgcagattgtagatgaaaatggtaagtattatctaccatatccagatcctagccgtattatttctgctggtgtttttgtggatgacatcactaagactgatgctgtcattcttttggaacgctatgtttctctggctatagatgcctacccattgtctaagcatcctaaacctgagtacaggaaggtgttttacgcattgttagactgggtcaaacatctcaacaagactcttaacgaaggtgttttggagtctttttctgttacacttttagatgaacatgagtctaagttttgggatgaaagcttttatgctagtatgtatgagaagtctacagtattacaagctgctggtctttgtgtagtatgtggttctcaaacagttctaagatgcggtgattgtttacgcagaccgatgttgtgcactaagtgcgcctatgatcatgtgtttggcactgatcataagttcattttagctattacaccatatgtgtgtaacacatctggctgcaatgtaaatgacgttacaaaactgtatcttggaggtttgaattattactgtgtagaccacaaaccacatctttcattcccactgtgttcagctggtaatgtctttggtttgtacaaaagttctgctttgggttccatggacattgatgtctttaacaaactttctacctctgattggtctgacattcgcgactacaagcttgctaatgatgcaaaagagtcactaaggttgtttgcagctgaaacggtcaaggccaaagaggaaagtgttaagtcatcatacgcttatgctaccctaaaggagattgtaggtcctaaggaacttttgctcttatgggaaagtggaaaagccaaaccaccgttaaaccgtaattctgtttttacatgcttccaaattacaaaagactccaagtttcaagttggtgagtttgtgtttgagaaagtagattacggttctgatacggttacttacaaatccactgctactactaagttagtaccaggtatgttgtttattttgacttctcataatgttgctccacttagagcgccaacaatggcaaaccaggagacatattctaccatttacaagttgcacccatcatttaatgttagtgatgcttatgcaaatcttgtaccttattaccaacttattggcaaacagcgtataaccacaatacagggtcctcctggtagtggaaaatcgcattgttctattggtattggtgtgtattaccctggagcgaggatcgtgttcaccgcttgttctcacgctgctgttgattcgctctgtgcaaaagctgtcacagcctatagtgttgataagtgtacacgtattattcctgcacgtgccagagttgagtgttatagtggttttaaacctaacaataatagtgcacaatacgtgtttagtactgttaatgcgttacctgaagttaatgcagacattgttgtcgtggatgaggtgtctatgtgcactaactatgacttgtctgtgattaaccagcgtatatcatataaacacattgtatatgttggtgatcctcaacagcttccagctcctagagttcttatctctaaaggtgttatggaaccaattgactataatgttgtgacacaacgtatgtgtgctataggacccgatgtctttttacacaagtgttacagatgtcctgctgaaatagttaacactgtttcagagcttgtttatgaaaacaagtttgtacctgtcaaagaagctagtaagcagtgcttcaaaatctttgaacgcggtagtgttcaggtagacaatggctccagtataaataggcgtcaacttgatgttgttaagcgatttatacataaaaactccacatggagcaaggctgtgtttatctcaccttacaatagtcaaaattatgtagctgccaggcttttaggcttacaaactcagacagtggattctgctcaaggtagtgaatatgactatgttatattcgcacagacatcagatactgctcatgcctgtaatgccaatcgttttaacgttgccattactagagcaaagaaaggtattttctgtattatgtctgacagaactttgtttgatgcacttaagttctttgaaatcactatgacagatttacagtctgaaagtagttgtggtttgtttaaggattgtgcacgtaaccctattgatttaccaccaagtcatgccactacttatttgtcattgtctgatagatttaagactagtggtgacttggctgttcaaataggtaacaacaatgtttgtacctatgaacatgtgatttcatatatgggtttcaggtttgatgttagcatgcctggtagtcatagtttgttctgtactagagactttgccatgcgtcatgtcagaggttggttaggaatggatgtggaaggtgcacatgtcacaggtgacaatgttggcactaatgtacctctacaagttggtttttccaatggtgttgattttgtagctcaacctgaaggttgtgttctaacaaacactggcagtgttgtaaaacctgttcgtgctcgtgcaccacctggagaacaattcactcacattgtacctctgttacgcaagggacaaccttggagtgtgttgagaaaacgtattgttcaaatgatagcagattttcttgctggctcatctgatgtactggtgtttgtactttgggctggcggtttagagttgaccactatgcgttattttgttaagattggagctgttaaacattgccaatgtggtactgttgcaacatgctacaattctgttagtaatgactattgttgctttaaacatgcattgggctgtgactatgtttataatccatatgtcatagatattcaacaatggggttatgttggttcactctccactaatcaccatgcaatttgtaatgttcatagaaatgagcatgttgcttctggtgatgctattatgactagatgtttggctgtgtatgactgctttgttaagaatgtggattggtcaattacctaccctatgatagctaatgaaaatgccataaacaagggcggtcgcactgtgcagagtcatattatgcgtgctgctattaaattgtacaaccctaaagcaatccatgacattggtaatcctaagggtattcgttgtgctgtaactgatgccaagtggtattgttatgacaagaaccctattaattctaatgtgaaaacattggaggatgattacatgacacatggccaaatggatggcttgtgtttgttttggaattgtaatgtggatatgtaccctgaattctcaattgtttgcaggtttgacacacgtacacgatctacattgaaccttgaaggtgtaaatggtgggtcattgtatgtcaataatcatgcatttcacactcctgcttatgataaacgtgctatggctaaattgaaaccagcaccgtttttctactatgacgacggttcatgtgaggttgttcacgatcaagttaactatgttcctttgagagccactaattgcattaccaagtgtaatattggtggtgctgtatgttctaagcacgctaatctctatagagcatatgttgagtcatataacatttttactcaagctggttttaatatttgggttcctaccacgtttgattgttataatttgtggcagacattcacagaggtcaatttacaaggtttagagaacattgcttttaacgttgttaataaaggttcatttgttggtgctgatggtgaattaccagtagccattagtggtgataaagtgttcgtacgtgatggtaacactgataatttagtctttgttaacaaaacatcactgcctacaaacatagcatttgaactttttgctaagaggaaggttggtttaacaccacctctcagtattctcaaaaaccttggtgttgtcgccacatataagtttgtcttgtgggattatgaagctgagcgtcccttgacaagctttactaagtctgtttgtggttatacagactttgcagaggatgtttgtacttgttacgataatagtatacaaggttcatacgaacgttttactctgtcaactaatgctgtgttattctctgctactgctgtgaaaacaggtggtaagagtttgccggctattaaattgaattttggaatgcttaatggtaatgcaattgctactgtcaaatcagaagatggtaacataaaaaatattaactggtttgtttacgtacgcaaagatggcaaacctgttgatcattatgatggtttttatacccaaggtcgtaatttacaagactttttgcctcgcagcacaatggaagaagactttttgaacatggatataggcgtgtttattcaaaagtatggtctagaggatttcaacttcgagcacgttgtgtatggtgatgtttcaaaaactactctaggcggtttacacttgttgatttcacaagtacgtctgagtaaaatgggcatcttaaaggcagaggagtttgtggcagcatctgacataacactcaaatgttgtactgtgacttatcttaatgatcctagttctaagactgtttgtacttacatggatttgttgttggatgattttgtttctgtattgaagtctttggatttgactgttgtatccaaggttcatgaggtcataattgacaacaaaccatggagatggatgctatggtgtaaagataatgccgttgctacattctatcctcagttgcagagtgcagaatggaaatgcgggtattctatgcctggtatttataagacacaacgtatgtgcttagaaccatgtaatttgtataattatggtgcaggtttgaagttgcccagtggcattatgttcaatgttgttaaatacactcaattgtgtcaatattttaacagtaccacgttatgtgttcctcataatatgagagtgttacacttgggtgctggctctgattatggtgttgcaccaggaactgctgttcttaaaaggtggttgccgcacgacgcaattgttgttgacaacgatgttgttgactatgtgagtgacgctgattttagtgttactggtgattgtgcaaccgtttatttggaagacaagtttgacttgttaatctctgatatgtacgatggtaggacaaaggcaattgatggtgaaaatgtttcgaaagaaggatttttcacttacatcaatggtttcatttgtgaaaaacttgccatcggaggttcgattgctattaaagtaacagagtatagctggaataagaaattgtatgaacttgtacaaagattttctttttggactatgttttgcacttctgttaatacgtcatcatcagaagcctttgttgtcggaattaactatcttggtgatttcgcacaaggaccttttatagatggtaacataatacacgcaaattatgtattttggcgtaactccactgttatgagtttgtcctacaactctgttttagacctgagtaaatttaattgcaaacacaaagcgactgttgttgtgcaattaaaggatagtgatattaatgaaatggtgcttagtcttgttaggagtggtaagttgcttgtaaggggtaatggcaagtgtttgagttttagtaatcatttagtctcaactaaataaaatgtttgtttt

SEQ ID NO: 33 - DNA, 922 bp, Coronavirus
atttaacaaatttggaaaagccaggctctattatgaagcattatcatttgaggaacaggatgaaatttacgcttatactaagcgtaatgtcctgccaacacttactcaaatgaatttgaaatatgctattagtgctaagaatagagcccgcactgttgctggtgtttccatacttagtactatgactggcagaatgtttcatcaaaaatgtttgaaaagtatagcagctacacgtggtgttcctgtagttataggcaccactaaattttatggtggctgggatgatatgttacgccgccttattaaagatgttgacaatcctgtacttatgggttgggattatcctaagtgtgatcgtgctatgccaaacctactacgtattgttagtagtttggtattagcccgaaaacatgagacatgttgttcgcaaaggactaggttttatcgacttgcgaatgaatgcgcacaagttttgagtgaaattgttatgtgtggtggctgttattatgttaagcctggtggcactagtagtggtgatgcaactactgcttttgctaattcagtctttaacatatgtcaagctgtttcagccaatgtatgtgccttaatgtcatgcaatggcaataagattgaagatcttagtatacgtgctcttcagaagcgcttatactcacatgtgtatagaagtgataaggttgattcaacctttgtcacagaatattatgaatttttaaataagcattttagtatgatgattttgagtgatgatggggttgtgtgttataattctgattatgcgtccaaagggtatattgctaatataagtgcctttcaacaggtattatattatcaaaataacgtttttatgtcagaatccaaatgttgggttgaacatgacataaataatggacctcatgaattc

SEQ ID NO: 34 - DNA, 8473 bp, Coronavirus
tgtgaccatgctggcactggtatggccattactattaagccggaggccaaccactaatcaggattcttatggtggtgcttccgtttgtatatattgccgctcgcgtgttgaacatccagatgttgatggattgtgcaaattacgcggcaagtttgtccaagtgcccttaggcataaaagatcctgtgtcatatgtgttgacgcatgatatttgtcaggtttgtggcttttggcgagatggtagctgttcctgtgtaggcacaggctcccagtttcagtcaaaagacacgaactttttaaacggattcggggtacaagtgtaaatgcccgtcttgtaccctgtgccagtggcttggacactgatgttcaattaagggcatttgacatttgtaatgctaatcgagctggcattggtttgtattataaagtgaattgctgccgcttccagcgtgtagatgaggacggcaacaagttggataagttctttgttgttaaaagaactaatttagaagtgtataataaggagaaagaatgctatgagttgacaaaagaatgcggtgttgtggctgaacacgagttcttcacatttgatgtggagggaagtcgggtaccacacatagtccgtaaagatctttcaaagtttactatgttagatctttgctatgcattgcgtcattttgaccgcaatgattgttcaactcttaaggaaattctccttacatatgctgagtgtgaagagtcctacttccaaaagaaggactggtatgattttgttgagaatcctgatataattaatgtgtataaaaagcttggtcctatatttaatagagccctgcttaacactgccaagtttgcagacgcattagtggaggcaggcttagtaggtgttttaacacttgataatcaagatttatatggtcaatggtatgactttggagattttgtcaagacagtacctggttgtggtgttgccgtggcagactcttattattcatatatgatgccaatgctgactatgtgtcatgcgttggatagtgagttgtttgttaatggtacttatagggagtttgaccttgttcagtatgattttactgatttcaagctagagctcttcactaagtattttaagcattggagtatgacctaccacccgaacacctgtgagtgcgaggatgacaggtgcattattcattgcgccaattttaatatactttttagtatggtcttacctaagacctgttttgggcctcttgttaggcagatatttgtggatggtgttcctttcgttgtgtcgatcggttaccattataaagaattaggtgttgttatgaatatggatgtggatacacatcgttatcgcttgtctcttaaggacttgcttttgtatgctgcagaccctgcccttcatgtggcgtctgctagtgcactgcttgatttgcgcacatgttgttttagcgttgcagctattacaagtggcgtaaaatttcaaacagttaaacctggaaattttaatcaggatttttatgagtttattttgagtaaaggcctgcttaaagaggggagctccgttgatttgaagcacttcttctttacgcaggatggtaatgctgctattactgattataattattacaagtataatctacccaccatggtggatattaagcagttgttgtttgttttagaagttgttaataagtattttgagatctatgagggtgggtgtatacccgcaacacaggtcattgttaataattatgataagagtgctggctatccatttaataaatttggaaaggccaggctctattatgaggcattatcatttgaggagcaggatgaaatttatgcgtataccaaacgcaatgtcctgccgaccctaactcaaatgaatcttaaatatgctattagtgctaagaatagggcccgcaccgttgctggtgtctctattctcagtactatgactggcagaatgtttcatcaaaagtgtctaaagagtatagcagctactcgcggtgttcctgtagttataggcaccacgaagttctatggcggttgggatgatatgttacgccgccttattaaagatgttgatagtcctgtactcatgggttgggactatcctaaatgtgatcgtgctatgccaaacatactgcgtattgttagtagtttggtgctagcccgtaaacatgattcgtgctgttcgcatacggatagattctatcgtcttgcgaacgagtgcgcccaagttttgagtgaaattgttatgtgtggtggttgttattatgttaaaccaggtggcactagtagtggggatgcaaccactgcttttgctaattctgtgtttaacatttgtcaagctgtttccgccaatgtatgctcgcttatggcatgcaatggacacaaaattgaagatttgagtatacgcgagttacaaaagcgcctatactctaatgtctatcgtgcggaccatgttgaccccgcatttgttagtgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggccaaatgttgggtagaaacagacatcgaaaagggaccgcatgaattttgttctcaacatacaatgctagtcaagatggatggtgatgaagtctaccttccataccctgatccttcgagaatcttaggagcaggctgttttgttgatgatttattaaagactgatagcgttctcttgatagagcgtttcgtaagtcttgcaattgatgcttatcctttagtataccatgagaacccagagtatcaaaatgtgttccgggtatatttagaatatataaagaagctgtacaatgatctcggtaatcagatcctggacagctacagtgttattttaagtacttgtgatggtcaaaagtttactgatgagaccttttacaagaacatgtatttaagaagtgcagtgctgcaaagcgttggtgcctgcgttgtctgtagttctcaaacatcattacgttgtggcagttgcatacgcaagcctttgctgtgttgcaaatgcgcctatgatcatgttatgtccactgatcataaatatgtcctgagtgtgtcaccatatgtgtgtaattcaccgggatgtgatgtaaatgatgttaccaaattgtatttaggtggtatgtcatattattgtgaggaccataaaccacagtattcattcaaattggtgatgaatggtatggtttttggtttatataaacaatcttgtactggttcgccctacatagaggattttaataaaatagctagttgcaaatggacagaagtcgatgattatgtgctagctaatgaatgcaccgaacgccttaaattgtttgccgcagaaacgcagaaggccacagaagaggcctttaagcaatgttatgcgtcagcaacgatccgtgagatcgtgagcgatcgggagttaattttatcttgggaaattggtaaagtgagaccaccacttaataaaaattatgtttttactggctaccattttactaataatggtaagacagttttaggtgagtatgtttttgataagagtgagttgactaatggtgtgtattatcgcgccacaaccacttataagttatctgtaggtgatgtgttcattttaacatcacacgcagtgtctagtttaagtgctcctacattagtaccgcaggagaattatactagcattcgttttgctagtgtttatagtgtgcctgagacgtttcagaataatgtgcctaattatcagcacattggaatgaagcgctattgtactgtacagggaccgcctggtactggtaagtcccatctagccattgggctagctgtttattattgtacagcgcgcgtggtgtataccgctgctagccatgctgcagttgacgcgctgtgtgaaaaggcacataaatttttaaatattaatgactgcacgcgtattgttcctgcaaaggtgcgtgtagattgttatgataaatttaaggtcaatgacaccactcgcaagtatgtgtttactacaataaatgcattacctgagttggtgactgacattattgtcgttgatgaagttagtatgcttaccaactatgagctgtctgttattaacagtcgtgttagggctaagcattatgtgtatattggagaccctgcgcagttacctgcaccacgtgtgctactgaataagggaactctagaacctagatattttaattccgttaccaagctaatgtgttgtttgggtccagatattttcttgggcacctgttatagatgccctaaggagattgtggatacggtgtcagccttggtttataataataagctgaaggctaaaaatgataatagctccatgtgctttaaggtttattataagggccagactacacatgagagttctagtgctgttaatatgcagcaaatacatttaattagtaagtttttaaaggcaaaccccagttggagtaacgccgtatttattagtccttataatagtcagaactatgttgctaagagagtcttgggattacaaacccagacagtagactcagcgcagggttctgaatatgattttgttatttattcacagactgcggaaacagcgcattctgtcaatgtaaatagattcaatgttgctattacacgtgctaagaagggtattctctgtgtcatgagtagtatgcaattatttgagtctcttaattttactacactgacgttggataagattaacaatccacgattacagtgtactacaaatttgtttaaggattgtagcaggagctatgtaggatatcacccagcccatgcaccatcctttttggcagttgatgacaaatataaggtaggcggtgatttagccgtttgccttaatgttgctgattctgctgtcacttattcgcggcttatatcactcatgggattcaagcttgacttgacccttgatggttattgtaagctgtttataactagagatgaagctatcaaacgtgttagagcctgggttggcttcgatgcagaaggtgcccatgcgatacgtgatagcattgggacaaatttcccattacaattaggcttttcgactggaattgattttgttgtcgaagccactggaatgtttgctgagagagatggttatgtctttaaaaaggcagccgcacgagctcctcctggcgaacaatttaaacaccttatcccacttatgtcaagagggcagaaatgggatgtggttcgaattagaatagtacaaatgttgtcagaccacctagtggatttggcagacagtgttgtacttgtgacgtgggctgccagctttgagctcacatgtttgcgatatttcgctaaagttggaagagaagttgtgtgtagtgtctgcaccaagcgtgcgacatgttttaattctagaactggatactatggatgctggcgacatagttattcctgtgattacctgtacaacccactaatagttgacattcaacagtggggatatacaggatctttaactagcaatcatgatcctatttgcagcgtgcataagggtgctcatgttgcatcatctgatgctatcatgacccggtgtctagctgttcatgattgcttttgtaagtctgttaattggaatttagaataccccattatttcaaatgaggtcagtgttaatacctcctgcaggttattgcagcgcgtaatgtttagggctgcgatgctatgcaataggtatgatgtgtgttatgacattggcaaccctaaaggtcttgcctgtgtcaaaggatatgattttaagttttatgatgcctcccctgttgttaagtctgttaaacagtttgtttataaatacgaggcacataaagatcaatttttagatggtttgtgtatgttttggaactgcaatgtggataagtatccagcgaatgcagttgtgtgtaggtttgacacgcgtgtgttgaacaaattaaatctccctggctgtaatggtggcagtttgtatgttaacaaacatgcattccacaccagtccctttacccgggctgccttcgagaatttgaagcctatgcctttcttttattattcagatacgccctgtgtgtatatggaaggcatggaatctaagcaggtcgattatgtcccattgagaagcgctacatgcatcacaagatgcaatttaggtggcgctgtttgtttaaaacatgctgaggagtatcgtgagtaccttgagtcttacaatacggcaaccacagcgggttttactttttgggtctataagacttttgatttttataacctttggaatacttttactaggctccaaagtttagaaaatgtagtgtataatttggtcaatgctggacactttgatggccgggcgggtgaactgccttgtgctgttataggtgagaaagtcattgccaagattcaaaatgaggatgtcgtggtctttaaaaataacacgccattccccactaatgtggctgtcgaattatttgctaagcgcagtattcggccccaccccgagcttaagctctttagaaatttgaatattgacgtgtgctggagtcacgtcctttgggattatgctaaggatagtgtgttttgcagttcgacgtataaggtctgcaaatacacagatttacagtgcattgaaagcttgaatgtactttttgatggtcgtgataatggtgctcttgaagcttttaagaagtgccggaatggcgtctacattaacacgacaaaaattaaaagtctgtcgatgattaaaggcccacaacgtgccgatttgaatggcgtagttgtggagaaagttggagattctgatgtggaattttggtttgctgtgcgtaaagacggtgacgatgttatcttcagccgtacagggagccttgaaccgagccattaccggagcccacaaggtaatccgggtggtaatcgcgtgggtgatctcagcggtaatgaagctctagcgcgtggcactatctttactcaaagcagattattatcctctttcacacctcgatcagagatggagaaagattttatggatttagatgatgatgtgttcattgcaaaatatagtttacaggactacgcgtttgaacacgttgtttatggtagttttaaccagaagattattggaggtttgcatttgcttattggcttagcccgtaggcagcaaaaatccaatctggtaattcaagagttcgtgacatacgactctagcattcattcgtactttatcactgacgagaacagtggtagtagtaagagtgtgtgcactgttattgatttattgttagatgattttgtggacattgtaaagtccctgaatctaaagtgtgtgagtaaggttgttaatgttaatgttgattttaaagatttccagtttatgttgtggtgcaatgaggagaaggtcatgactttctatcctcgtttgcaggctgctgctgactggaaacctggttatgttatgcctgtcttatataagtatttggaatcgcctctggaaagagtaaacctctggaattatggcaagccgattactttacctacaggatgtatgatgaatgttgctaagtatactcaattatgtcaatatttgagcactacaacattagcagttccggctaatatgcgtgtcttacaccttggtgccggttcggataagggtgttgcccctgggtctgcagttcttaggcagtggctaccagcgggaagtattcttgtagataatgatgtgaatccatttgtgagtgacagtgtcgcctcatattatggaaattgtataaccttaccctttgattgtcagtgggatctgataatttctgatatgtacgaccctcttactaagaacattggggagtacaacgtgagtaaagatggattctttacttacctctgtcatttaattcgtgacaagttggctctgggtggcagtgttgccataaaaataacagagttttcttggaacgctgagttatatagtttaatggggaagtttgcgttctggacaatcttttgcaccaacgtaaacgcctcttcaagtgaaggatttttgattggcataaattggttgaataagacccgtaccgaaattgacggtaaaaccatgcatgccaattatctgttttggagaaatagtacaatgtggaatggaggggcttacagtctctttgacatgagtaagttccctttgaaagcggctggtacggctgttgttagccttaaaccagaccaaataaatgacttagtcctctccttgattgagaagggcaagttattagtgcgtgatacacgcaaagaagtttttgttggcgatagcctagtaaatgtcaaataaatctatacttgtcgtggctgtgaaaatg

SEQ ID NO: 35 - DNA, 21798 bp, Coronavirus
tataagagtgattggcgtccgtacgtaccctctctactctaaaactcttgtagtttaaatctaatctaatctaaactttataaacggcacttcctgcgtgtccatgcccgtgggcctggtcttgtcatagtgctgacatttgtggttccttgactttcgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtaaccctgagaggtcagaggaggatgggttttgcccctctgctgcgcaagaaccgaaagttaaaggaaaaactttggttaatcacgtgagggtggattgtagccggcttccagccttggagtgctgtgttcagtccgccataatccgtgatatttttgttgacgaggatccccagaaggtggaggcctcgactatgatggcattgcagttcggtagtgctgtcttggtcaagccatccaagcgcttgtctgttcaggcatgggctaagttgggtgtgctgcctaaaactccggccatggggttgttcaagcgcttctgcctgtgtaacaccagggagtgcgtttgtgacgcccacgtggcctttcaactttttacggtccagcccgatggtgtatgcctgggtaacggccgttttataggctggttcgttccagtcacagccataccggagtatgcgaagcagtggttgcaaccctggtccatccttcttcgtaagggtggtaacaaagggtctgtgacatccggccatttccgccgcgctgttaccatgcctgtgtatgactttaatgtagaggatgcttgtgaggaggttcatcttaacccgaggggtaagtactcctgcaaggcgtatgctcttcttaggggctatcgcggtgttaagcccatcctgtttgtggaccagtatggttgcgactatactggatgtctcgccaagggtctcgaagactatggcgaccttactttgagtgagatgaaggagttgtcccctgtgtggcgtgactccttagataatgaagttgttgtggcttggcatgttgatcgtgaccctcgagctgtgatgcgcctgcagactctggctactgtacgtagcattgagtatgtgggccaaccgatcgaggatatggttgatggggatgtggtgatgcgtgaacccgctcacctcctcgcgcccaatgccattgttaaaaggcttccccgtctggtggagactatgctgtatacggattcttccgttacagagttttgttataaaactaagttgtgtgattgtggttttatcacacagtttggctatgttgattgctgtggtgacacctgtggttttcgtgggtgggttcctggcaatatgatggatggctttccatgccctgggtgttgtaaaagttacatgccttgggagttggaagctcaatcatcgggtgttataccagaaggaggtgttctatttacgcagagcactgacacagtgaatcgtgagtcttttaagctctacggtcatgctgttgtgccttttggtggtgctgcgtattggagtccatatcctggtatgtggcttccagtaatttggtcttctgttaagtcatattcctatttgacttatacaggagttgttggttgtaaggcaattgtccaggagacagacgctatatgtcgttttctgtacatggactatgtccagcacaagtgtggcaatctcgagcagagggctatccttggattggacgatgtctatcatagacagttgcttgttaacaggggtgactatagtctcctccttgaaaatgtggatttgtttgttaagcggcgcgctgaatttgcttgcaaattcgccacctgtggagatggccttgtaccccttctactagatggtttagtgccccgcagttattatttaattaagagtggtcaagcttttacctcattgatggttaactttagccgagaggtagttgacatgtgtatggacatggctttattgttcatgcatgatgttaaagtggccactaagtatgttaagaaggttactggcaaagtagcagtgcgctttaaagcgttaggcattgctgttgtcagaaaaattactgaatggtttgacttagccgtggacactgctgctagtgccgctggatggctttgctaccagctggtaaatggcttatttgcagtagccaatggtgttataacctttatacaggaggtgcctaactatcaagaatttattaacaatcagcatttcaattcacacctgcatccgcctgagcttgtcaagaattttgttgacaagttcaagacatttttcaaggtcttgatcgactctatgtcggtctctatcttgtctggacttactgttgtcaagactgcctcaaatagggtatgtcttgctggcagtaaggtttatgaagttgtgcagaaatctctgcctgcatatattatgcctgtgggttgcagcgaagccacttgtttggtgggtgagattgaacctgcagtctttgaagatgatgttgttgatgtggttaaagccccgttaacatatcaaggctgttgtaagccaccctcttctttcgagaagatttgtattgtggataaattatatatggccaagtgtggtgatcaattctaccctgtggtggttgataacgacactgttggcgtgttagatcagtgctggaggttcccctgcgcgggcaagaaagtcgtgtttaacgacaagcctaaagttaaggaggtaccctccacgcggaagattaagattatcttcgctctggatgcgacctttgatagtgttctctcgaaggcatgttcagagtttgaagttgataaagatgttacattggatgagctgcttgatgttgtgcttgacgcagttgagagtacgctcagcccttgtaaggagcatggtgtgataggcacaaaagtttgtgctctacttaaaggttggtggacgattatgtctatctttttgatgaaggaggcgaagaagttattgccctcccgtatgtatgtcctctctgctcctgatgaagactgcgttgcaacagatgttgtatatgcagatgaaaaccaagatgatgatgctgacgatcctgtagtccttgtcgccgatacccaagaagaggacggcgttgccagggagcaggttgattcggctgattcggaaatttgtgttgcgcacactggtggtcaagaaatgactgagcctgatgtcgtcggatctcaaactcccatcgcctctgctgaggaaaccgaagtcggtgaggcatgcgacagggaagggattgctgaggtcaaggcaactgtgtgtgctgatgctttagatgcctgccccgatcaagtggaggcatttgatattgaaaaggttgaagactctatcttaagtgagcttcaaaccgaacttaatgcgcccgcggacaagacctatgaggatgtcttggcattcgatgccatatactcagagacgttgtctgcattctatgctgtgccgagtgatgagacgcactttaaagtgtgtggattctattcgccagctatagagcgtactaattgttggctgcgttctactttgatagtaatgcagagtttacctttggaatttaaagacttggggatgcaaaagctctggttgtcttacaaggctggctatgatcaatgctttgtggacaaactagttaagagcgcgcccaagtctattattcttccacaaggtggctatgtggcagattttgcctattttttcctaagccagtgtagcttcaaagttcatgctaactggcgttgtctaaagtgtggcatggagttaaagcttcaaggcttggacgccgtgtttttctatggagacgttgtgtctcatatgtgtaagtgtggtaatagcatgaccttgttgtctgcagatataccttacacattcgattttggagtgcgagatgacaaattttgtgctttttacacgccgagaaaagtctttagggctgcttgtgcggttgatgttaatgattgccactctatggctgttgtggatggcaagcaaattgatggtaaagttgttaccaaatttaatggtgacaaatttgattttatggtgggtcatggtatgacatttagtatgtctccctttgagatcgcccagttatatggttcatgtataacaccaaatgtttgttttgttaaaggagatgttataaaggttttgcgcagagttggtgctgaagtcatcgtcaaccctgctaatgggcgcatggctcatggtgcgggtgttgcaggtgctatagctaaagcagcgggcaaagcttttattaatgagactgccgatatggtgaaggctcagggcgtttgccaggttggtggatgctatgagtctaccggtggtaaattatgtaagaaagtgcttaacattgtaggaccagatgcgcgagggcatggcaacgaatgctattcacttttagagcgtgcttatcagcatattaataagtgtgacaatgttgtcaccactttaatttcggctggtatatttagtgtgcctactgatgtttccttaacttatctacttggtgtagtgacgaagaatgtcattcttgtcagtaataaccaggatgattttgatgtgatagagaagtgtcaggtgacctccgttgctggtaccaaagcgctatcatttcaattggccaaaaatttgtgccgtgatgtaaagtttgtgacgaatgcatgtagttcgctctttagtgaatcaagctttgtctcaagctatgatgtgttgcaggaagttgaagcgctggacatgatatacaattggatgatgatgctcgtgtctttgtgcaggctaatatggactgtctgcccacagactggcgtcttgtcaataaatttgatagtgttgatggtgttaagaaccattaagtattttgaatgtccgggcgaggtttttgtatctagccagggcaaaaagtttggttatgttcagaatggttcatttaaggaggcgagtgttagccaaataagggctttgcttgctaataaggttgatgtcttgtgtactgttgatggtgttaacttccgctcctgctgtgttgcagagggtgaagtttttggcaagacattaggttcagttttttgtgatggtataaatgtaaccaaagttaggtgtagtgccattcacaagggtaaggttttctttcagtatagtggtctgtctgcggcagatctcgctgctgttaaagatgcctttggttttgatgaaccacaactgctgcagtactacagtatgcttggcatgtgtaagtggccagtagttgtttgtggcaattattttgcttttaagcagtcaaataataattgctatataaatgtggcatgtttaatgctgcaacacttgagtttaaagtttcctaagtggcaatggcggaggcctggaaatgagttccgctcaggtaagccactaaggttcgtgtccttggtcttagcgaagggcagctttaaatttaatgaaccttctgattcaactgattttatacgtgtggagctgcgcgaagcggatttgagtggtgccacatgtgatttggaatttatttgtaaatgtggtgtgaagcaagagcagcgcaaaggtgttgacgctgttatgcattttggtacattggataaaagtggtcttgtcaagggttataatatcgcatgtacatgcggtgataaacttgtgcattgcactcaatttaatgtaccatttttaatctgctccaacacgcctgagggcaagaaattgcctgacgatgttgttgcagctaacatatttactggtggtagtgtgggccactacacgcatgtgaaatgtaaacccaagtaccaactttatgatgcttgtaatgttagtaaggtttctgaggcgaagggtaattttaccgattgcctctaccttaaaaatttaaagcaaactttttcgtccgtgttgacgacttattatttagatgatgtaaagtgtgtggcgtataagccagatttatcgcagtattactgtgagtctggaaaatattatacaaaacccattattaaggctcagtttagaacgtttgagaaggttgagggtgtctacactaattttaaattggtgggacatgatatagccgaaaaactcaatgctaagctgggatttgattgtaattctccttttatggagtataaaattacagagtggccaacagctactggagatgtggtgttggctagtgatgatttgtatgtgagtcggtattcaggcgggtgcgttacttttggtaaaccggttatctggcgtggccatgaggaagcatcgctgaaatccctcacatattttaatagacctagtgtcgtttgtgaaaataaatttaatgtgttgcctgttgatgtcagtgaacccacggataggggcctgtgccgtctgcagtccttgttaccggtgctgcgagtggtgctggcgtcagctatatccattgagcccggtactgccaaggagcaaaaggcgtgtgcttctgatagcgtggaggatcagattgttatggaggcccagaagaagtcatctgtcacaaccgttgctgtcaaagaggttaaattgaatggtgttaagaagcctgttaagtggaactgtagtgtggttgttaatgaccccactagcgaaaccaaagttgttaaaagtttgtctattgttgatgtgtatgatatgttcctgacagggtgtaggtatgtggtctggacggctaatgagctgtctcgattaataaattcacctactgttagagagtatgttaagtggggtatgtcgaagttaatcatccccgctaatttgttattgttaagagatgagaagcaagagtttgtagcgccaaaagtggtcaaagcgaaagctattgcctgctatggcgctgtgaagtggtttctcctctattgttttagttggataaagtttaatactgataataaggttatatacaccacagaagtagcttcaaagcttacttttaagttatgctgtttggcctttaagaatgccttacagacgtttaattggagcgttgtgtctaggggtttcttcctagtggcaacggtctttttattatggtttaattttttgtatgccaatgttattttgagtgacttttatttgcctaatattggacctctccctatgtttgtggggcagattgttgcttgggttaagactacatttggtgttttaaccatctgcgatttttaccaggtgacagatttaggctataggagttcgttttgtaatggaagtatggtctgtgaactatgcttctctggttttgatatgctggacaactatgagtccataaatgttgttcaacatgttgtagataggcgtgtgtcttttgactacattagcctatttaaattagtagtcgaacttgttatcggctactctctatatactgtgtgcttctacccactgtttgtccttgttggaatgcagttgttgaccacatggttgcctgaattctttatgctggggactatgcattggagcgctcgtttgtttgtttttgttgctaacatgctcccagcttttacgttactgcgattttatatcgtggtgacagctatgtataaggtctattgtctttgtagacatgttatgtatggatgtagtaagcctggttgcttgttttgttataagagaaaccgtagtgtccgcgttaagtgtagcaccgttgttggtggttcactacgctattacgatgtaatggctaacggcggcacaggtttctgtacaaagcaccagtggaactgtcttaattgcaattcctggaaaccaggcaatacattcataactcatgaagcagcagcggacctctctaaagagttgaaacgccctgtgaatccaacagactctgcttattactcggtcatagaggttaagcaggttggttgttccatgcgtctgttctatgagagagacggacagcgtgtttatgatgatgttagtgctagtttgtttgtggacatgaatggtctgctgcattctaaagttaaaggtgtgccagaaactcatgttgtagtcgttgagaacgaagccgataaggccggttttcttaacgctgctgttttctatgcacaatctctttatagaccgatgctgatggtggagaagaagttaataactaccgccaacactggtttgtctgttagtcgaactatgtttgacctctatgtatactccttgctgaggcaccttgacgtcgatcgcaagagcctaacaagctttgtaaatgctgcgcacaactccctaaaggagggtgttcagcttgaacaggtaatggatacctttgttggctgtgctcgacgtaagtgtgctatagattctgatgttgagaccaagtctattaccaagtccgttatggcggcagtgaatgctggcgttgaggttacggacgagagttgtaataacttggtgcccacatatgttaaaagcgacactatcgttgcagctgatttgggtgttcttattcagaataatgctaagcatgtacagtctaatgttgctaaagccgctaatgtggcttgcatttggtctgtggatgcttttaaccagctatctgctgatttgcagcataggttgagaaaagcatgtgtaaagactggcttgaagattaagcttacgtataacaagcaggaggcaaatgttcctattttaactacaccgttctcccttaaagggggcgctgtgtttagtagagttttgcaatggttgtttgttgctaatttgatctgtttcattgtattgtgggcccttatgccgacatacgcagtgcacaaatcagatatgcagttgcctttatatgccagtttcaaagttatagataatggtgtgctaagggatgtgtctgttactgacgcatgcttcgcaaacaaatttaatcaatttgatcagtggtatgagtctacatttggtcttgtctattaccgtaactctaaggcttgccctgttgtggttgctgttatagatcaagacattggccataccttatttaatgttcctaccaaagttttaagatatggatttcatgtgttgcattttataactcatgcatttgctactgatagggtgcagtgttatacgccacatatgcaaatcccctatgataatttctatgctagtggttgcgtgctgtcttccctctgtaccatgcttgcgcatgcagatggaaccccgcatccttattgttatacagagggtgttatgcataatgcttctctgtatagttctttggtccctcatgtccgttataacctagctagttcaaatggttatatacgttttcctgaagtggttagtgagggtattgtgcgtgtagtgcgcacgcgctccatgacctactgcagggttggtttatgtgaggaggctgaggagggtatttgttttaattttaatagttcatgggtactgaataacccgtattatagggctatgccaggaactttctgtggtagaaacgcttttgatttaatacatcaagttttaggaggtttagtccagcctattgatttctttgccttaacggcgagttcagtggctggcgctatccttgcaattattgttgttttggcgttttattatttaataaagcttaaacgtgcctttggtgactacactagtgttgtagtcatcaatgtcattgtgtggtgtataaatttcctgatgctattcgtgtttcaggtttatcccactttgtcttgtttgtatgcttgcttttacttttacacaacgctctatttcccttcggagataagtgttgttatgcatttgcagtggcttgtcatgtatggtgctattatgcccttgtggttttgcattacctacgtggcagtcgttgtctcaaaccatgctttgtggttgttctcttactgccgcaaaatcggtaccgatgttcgtagtgatggcacatttgaggaaatggcccttactacctttatgattactaaagaatcttattgtaagttgaaaaattctgtttctgatgttgcttttaacaggtacttgagtctttataacaagtatcgctattttagtggcaaaatggatactgctacttatagagaggctgcttgttctcaactagcaaaggcaatggaaacatttaaccataacatggtaatgatgttctctatcagctcactgctctgtactacatcatttttacagtctggtatagtgaagatggtgtcccccacttctaaggtggaaccttgtgtagttagtgttacctatggtaatatgacacttaatgggttgtggttggatgataaagtttattgtccaagacatgttatctgttcttcagctgacatgacagaccctgattatcctaatttgctttgtagagtgacatcaagtgacttttgtgttatgtctgaccgtatgagccttaccgtgatgtcttaccaaatgcagggcagtctacttgtgttgactgtaacattgcaaaatcctaacacgcctaagtattcctttggcgttgttaagcctggtgagacgtttaccgttttggctgcatacaatggcagaccccagggagccttccatgttgttatgcgtagcagccataccataaagggctcctttttgtgtggatcctgcggttctgtagggtatgtgttaactggtgatagtgtacgatttgtttatatgcatcagctagagttgagtactggttgtcacaccggtactgactttagtgggaatttctatggtccctatagagatgctcaggttgtacaattgccagttcaagattatacgcagactgttaatgttgtagcttggctttatgctgctattcttaacaggtgcaattggtttgtgcaaagtgatagttgttctctggaagaatttaatgtctgggctatgaccaatggttttagctcaatcaaagctgaccttgtcttggatgcccttgcctctatgacaggtgtcacagttgaacaggtgttggccgctattaagaggctgcattctggattccagggtaaacaaattttaggtagttgtgtgcttgaagatgagttgacaccaagtgatgtttatcaacaactagctggtgttaagctacagtcaaagcgcacaagagttattaaaggtacatgttgctggatattggcttcaacatttttgttttgtagcattatctcagcatttgtaaaatggactatgtttatgtatgttactactcatatgttgggagtgacattgtgtgcactttgttttgtaatctttgctatgttgttgattaagcataagcatttgtatttaaccatgtatattatgcctgttttatgcacattgttttacacgaactatttggttgttgggtataaacagagttttagaggcttagcatatgcttggctttcatactttgtccctgccgtagactatacttacatggatgaagtattatatggtgtcgtgttgctagtcgctatggtatttgttaccatgcgcagcataaatcacgacgtcttttctactatgttcttggttggtagacttgtcagcctggtatctatgtggtattttggagccaatttagaggaagaggttctgttgttcctcacatccctatttggcacgtacacatggactactatgctgtcattggctactgctaaggttattgctaaatggttggctgtgaatgtcttgtatttcacagacataccgcaaattaaattagttctcttgagctatttgtgtattggttatgtgtgttgttgttattggggcgtcttgtcactccttaatagcatttttaggatgccattgggcgtctacaattataaaatctccgtgcaggagttacgttatatgaatgctaatggcttgcgcccacccagaaatagttttgaagccttgatgcttaattttaagctgttgggaattggtggtgtgccagtcattgaagtatctcaaattcaatcaagactcactgatgttaaatgtgctaatgttgtgttgcttaattgcctccagcacttgcacattgcatctaattctaagttgtggcagtattgcagtactttgcataatgaaatattagccacatctgatttgagcgtagccttcgataagttggcccagctcttagttgtcttatttgctaatccagcagcagtggatagcaagtgccttgcaagtattgaagaagtgagcgatgattacgttcgcgacaatactgttttgcaagctttacagagtgaatttgttaatatggctagcttcgttgagtatgagcttgctaagaagaacttagatgaggccaaggctagcggctctgctaatcaacagcagattaagcagctagagaaggcttgtaatattgctaagtcagcatacgagcgcgatagagctgttgctcgtaagctagagcgtatggctgatttggctcttactaatatgtacaaggaagctagaattaatgataagaagagtaaggtagtgtcggcattgcaaaccatgctgtttagtatggtccgtaagctagacaaccaagctcttaattctatcttagataatgcagttaagggttgtgtacctttgaatgcaataccaccattgacttcaaacactctgactataatagtgccagataagcaggtttttgatcaagttgtggataatgtgtatgtcacctatgctcccaatgtatggcatatacaatctattcaagatgctgatggtgctgttaaacaattgaatgagatcgacgttaattcaacctggcccctagtcatctctgcaaataggcataatgaagtgtctacggtcgttttgcagaacaatgagttgatgcctcagaagttgagaactcaggtcgtcaatagtggctcagatatgaattgtaatattcctacccagtgttattataatacgactggcacgggtaagattgtgtatgctatacttagtgactgtgacggtctcaagtacactaagatagtaaaagaagatggaaattgtgttgttttggaattggatcctccctgtaagttttcagttcaggatgtgaagggccttaaaattaagtacctttactttgtgaaggggtgtaatacactggctagaggctgggtcgtaggcaccttatcatcgacagtgagattgcaggcaggcacggcaactgagtatgcctccaactctgcaatactgtcgttgtgtgcgttttctgtagatcctaagaaaacgtacctggattatatacaacagggtggcgtgcctgtcactaattgtgtcaaaatgttatgtgaccatgcaggcactggtatggccattactattaagccggaggcaaccactaatcaggattcatatggtggtgcttctgtttgtatatattgccgctcacgtgttgaacatccagatgttgatggattgtgcaaattacgcggcaagtttgttcaagtgcccttaggcataaaggatcctgtgtcatatgttttgacgcatgatgtttgtcaagtttgtggcttttggcgagacggtagctgctcctgtgtaggtacaggctcccagtttcagtcaaaagacacgaattttttaaacgggttcggggtacaagtgtaaatgcccgtcttgtaccctgtgccagtggcttggacactgatgttcaattaagggcatttgatatttgtaatgctaatcgagctggcattggtttgtattataaagtgaattgcttccgatttcagcgtgtagatgaggagggcaacaagttggataagttctttgttgttaaaagaaccaatttagaagtgtataataaggagaaagaatgttatgagttgacaaaagattgtggtgttgtggctgaacacgagttcttcacatttgatgttgagggaagtcgtgtgccacacatagtccgtaaagatctttcaaagtttactatgttagatctttgctatgcattgcgtcattttgaccgcaatgattgttcaactctcaaggaaattctccttacatatgctgagtgtgatgagtcctattttcaaaagaaggactggtatgattttgttgagaatcctgatattattaatgtgtataagaagcttggtcctatatttaatagagccctgcttaacactgctaactttgcagacacgttagtggaggcaggcttagtaggtgttttaacacttgataatcaagatttatatggtcaatggtatgactttggagattttgtcaagacagtgccttgttgtggtgttgccgtggcagattcttattattcctatatgatgccaatgctgaccatgtgtcatgcgttggatagtgagttgtttgtcaatggtacttatagggagtttgaccttgttcagtatgattttactgatttcaagctagagctctttaataagtattttaagcattggagtatgacctaccacccgaacacctccgagtgcgaggatgacaggtgcattatccattgtgccaattttaatatactttttagtatggtcttacctaagacctgttttgggcctcttgttaggcagatatttgtggatggtgttcctttcgttgtgtcgattggctaccattataaagaattaggtgttgttatgaatatggatgtggatacacatcgttatcgcttgtctcttaaagacttgcttttgtatgctgcagatcctgcccttcatgtggcatctgctagtgcactgcttgatttgcgcacatgttgttttagcgttgcagctatcacaagtggcgtaaaatttcaaacagttaaacctggaaattttaatcaggatttttatgagtttattttgagtaaaggcctgcttaaagaagggagctccgttgatttgaagcacttcttctttacgcaggatggtaatgctgctattactgattataattattacaagtataacctacccaccatggtggatattaagcagttgttgtttgttgtggaagttgttaataagtattttgagatctatgagggtgggtgtatacccgcaacacaggtcattgttaataattatgataagagtgctggctacccatttaacaaatttggaaaggccaggctctattatgaggcattatcatttgaggagcaggatgaaatttatgcgtataccaaacgcaatgtcctgccgaccctaactcaaatgaatcttaaatatgctattagtgctaagaatagggcccgcaccgttgctggtgtctctattctcagtactatgactggcagaatgtttcatcaaaagtgtttaaagagtatagcagctactcgtggtgttcctgtagttataggcaccacgaagttctacggcggttgggatgatatgttacgccgccttattaaagatgttgatagtcctgtactcatgggttgggactatcctaaatgtgatcgtgctatgccaaacatactgcgtatcgttagtagtttggtgttagcccgtaaacatgattcgtgctgttcgcatacggacagattctatcgtcttgcgaacgagtgcgcccaagttttgggtgaaattgttatgtgtggtggttgttattatgttaaaccaggtggcactagtagtggggatgcaaccactgcttttgctaattctgtatttaacatatgtcaagctgtttccgccaatgtatgctcgcttatggcatgcaatggacacaaaattgaagatttgagtatacgcgagttacaaaagcgcctatactctaatgtgtatcgtgcggaccatgttgatcccgcatttgttagtgagtattatgagtttttaaataagcattttagtatgatcattttgagtgatgatggtgttgtgtgttacaattcagagttcgcgtccaagggttatattgctaatataagtgactttcaacaggtattatattaccaaaataatgtgttcatgtctgaggccaaatgttgggtcgaaacagacatcgaaaagggaccgcatgaattttgttctcaacatacaatgctagtaaagatggatggtgatgaagtttaccttccatatcctgatccttcgagaatcttaggagcaggctgttttgttgatgatttattaaagactgatagcgttctcttgatagagcgctttgtaagtcttgcaattgatgcttatcctttagtataccatgagaacccagagtatcaaaatgtgttccgggtatatttagaatatataaagaagctgtacaatgatctcggtaatcagatcctggacagcatcagtgttattttaagtacttgtgatggtcaaaaatttactgatgagaccttctacaagaacatgtatctaagaagtgcagtgatgcaaagcgttggggcctgcgttgtctgtagttctcaaacatctttacgttgtggcagttgcatacgcaagccattgctgtgttgcaagtgcgcttatgatcatgttatgtcaactgatcataaatatgtcctgagtgtgtcaccatatgtgtgtaattcgccgggatgtgatgtaaatgatgttaccaaattgtatctaggtggtatgtcatattattgtgaggcccataaaccacagtattcatttaaattagtgatgaatggtatggtttttggtttatacaaacaatcctgtactggttcgccctacatagaggattttaataaaatagctagctgcaaatggacggaagtcgatgattatgtgctagctaatgaatgtaccgaacgtcttaaattgtttgccgcagaaacgcagaaggccacagaggaggctttcaagcaatgttatgcgtcagcaacgatccgtgagatcgtgagcgatcgggagttaattttgtcttgggaaattggtaaagtgagaccaccacttaataaaaattatgtttttactggctaccattttactaataatggcaagacagttttaggtgaatatgtttttgataagagtgagttgactaatggtgtgtattatcgcgccacaaccacttataagttatctgtgggtgatgttttcatcttaacatcacacgcagtgtctagtttaagtgctcctacattagtaccgcaggagaattatactagcgttcgctttgctagtgcttatagtgtgcctgagacgtttcagaacaatgtgcctaattatcagcacattggaatcaagcgctattgcactgtacagggaccgcctggtactggtaagtcccatttagccattgggcatgctgtttattattgtactgctcgtgtggtgtataccgctgctagccatgctgcagttgacgcgctgtgtgaaaaggcacacaaatttttaaatattaatgactgcgcgcgtattgttcctgcaaagttgcgtgtagattgctatgataagtttaatgtcaatgacaccactcgtaagtatgtgtttactacaataaatgcattacccgagttggtgactgacattattgttgttgatgaagttagtatgcttaccaattatgagctgtctgttattaacagtcgtgttagggctaagcattatgtgtatattggagatcctgctcagctgcccgctcctcgtgtgctactgaataagggaactctagaacctagatattttaattctgttaccaagctaatgtgttgcttgggtccagatatcttcttgggtacctgttatagatgccctaaggagattgtggatacagtgtcagccttggtttataataataagctgaaggctaaaaatgataatagcgccatgtgttttaaggtctattataaaggccagactacacacgagagttctagtgctgttaatatgcagcaaatacatttaattagtaagcttttgaaggcaaaccccagctggagtaatgccgtatttattagtccttataatagtcagaactatgttgccaagagagtcctgggattacaaactcagaccgcagattcagcgcagggttctgcatatgacttcgttatttattcacagactgcgcaaacagcgcattctgtcaatgtaaatagattcaatgttgccattacacgtgctaagaagggtatcctctgtgtcatgagtagtatgcaattaattggggtttttaattttactacactgacgttggataagattaataatccacgattacagtgtactacaaatttgtttaaggattgtagcaagagctatgtaggtataccgccatgcgccttccttttggcagttgatgataaatataaggtaagtggcaatttagccgtttgccttaatgttgctgattctgctgtcacttattcgcggcttatatcactcatgggattcaagcttgacttgacccttgatggttattgtaagctgtttataacaagagatgaagctatcaaacgtgttagagcttgggtgggcttcgatgcagaaggtgctcatgcgacgcgtgatagcattgggacaaatttcccattacaattaggcttttcgactggaattgatttcgtcgtcgaggccactggaatgtttgctgagagagatggctacgtctttaaaaaggcagccgcacgagcacctcccggcgaacaatttaaacacctcgtcccacttatgtctagaggacagaaatgggacgtggttcgaattcgaatagtacaaatgctgtcagaccacctagtggatttggcagacagtgttgtacttgtgacgtgggctgccagcttcgagctcacatgtttgcgatatttcgctaaagttggaaaagaagttgtgtgtagtgtctgcaacaagcgtgcgacatgttttaattctagaactgggtactatggatgctggcgacatagttattcctgtgattacctgtataacccactaatagttgacattcaacagtggggatatacaggatctttaactagcaatcatgatcctatttgcagcgtgcataagggtgctcatgtcgcatcatccgatgctatcatgactcgatgcttagctgtccatgattgcttttgtaagtctgttaattggaatttagaataccccattatttcaaatgaggtcagtgttaatacctcctgcaggttattgcagcgcgtaatgttcagagctgcgatgctatgcaataggtatgatgtgtgttatgacattggcaaccctaagggtcttgcctgtgtcaaaggatatgattttaagttttatgatgcctcccctgttgttaagtctgttaaacagtttgtttataagtacgaggcacataaagatcaatttttagatggtttatgtatgttctggaactgcaatgtggataagtatcccgcgaatgcagttgtctgtaggtttgacacgcgagtgttaagcaaattaaatctccctggctgtaatggcggtagtctgtatgttaataaacatgcattccacaccaatccctttacgcgggctgccttcgagaatttaaagcctatgccgttcttttattattcagatacgccttgtgtgtatatggaaggcatggagtctaagcaggtcgattatgtcccactaagaagcgccacttgcattacaagatgcaatttagggggtgctgtttgtctaaaacatgctgaggagtatcgtgagtaccttgagtcttacaatacggctaccacagcgggttttactttttgggtctataagacttttgatttttacaacctttggaatacttttactaggctccaaagcttagaaaatgtagtgtacaatttggttaatgctggacactttgatggccgggcgggtgaactgccttgtgctgttataggtgagaaagtcattgccaagattcaaaatgaggatgtcgtggtcttcaaaaataacacgccattccctaccaatgtggctgtcgaattatttgctgagcgcagtattcggccccacccagagcttaagctcttcagaagttcaaatattcacgtgtgctggaatcacgtcctttgggattatgctaaggatagtgtgttttgcagttcgacgtataaggtctgcaaatacacagatttacagtgcattgaaagcttgaatgtactttttgatggtcgtgataatggtgctcttgaagcttttaagaagtgccggaatggcgtctacattaacacgacgaaaattaaaagtctgtcgatgattaaaggcccacaacgtgccgacttgaatggcgtagttgtggagaaagttggagattctgatgtggaattttggtttgctatgcgtagagacggtgacgatgttatcttcagccgtacagggagccttgaaccgagccattaccggagcccacaaggtaatccgggtggtaatcgcgtgggtgatctcagcggtaatgaagctctagcacgtggcactatctttactcaaagcagatttttgtcctctttctcacctcgatcggagatggagaaagattttatggatttagatgaagacgtgttcattgcaaaatatagtttacaggactacgcgtttgaacacgttgtttatggtagtttcaaccagaaaattattggaggtttgcacttgcttattggcttagcccgtaggccgaaaaaatccaatctggttattcaagagttcgtgccgtacgactctagcattcattcgtactttatcactgacgagaacagtggtagtagtgagagtgtgtgcactgttattgatttattgttagatgattttgtggacattgtaaagtccctgaatctaaagtgtgtgagtaaggttgttaatgttaatgttgattttaaagatttccagtttatgttgtggtgcaatgaggagaaggtcatgactttctaccctcgtttgcaggctgctgctgattggaaacctggttatgtaatgcctgtattatataagtatttggaatcgccaatggaaagagtgaatctctggaactatggcaagccgattactttacctacaggatgtatgatgaatgttgctaagtatactcaattatgtcaatatttgagtactacaacattagcggtccctgctaacatgcgtgtactacaccttggtgcagggtctgataagggtgttgcacctggatctgcagttcttaggcagtggttaccatcgggcagtattcttgtagataatgatatgaatccatttgtgagtgacagcgttgcctcatattatggaaattgtataaccttaccctttgattgtcagtgggatctgataatttctgatatgtacgaccctctcactaagaacattggggagtacaacgtgagtaaagatggtttctttacttacctttgtcatttaattcgtgacaagttggctctgggtggcagtgttgccataaaaataacagagttttcttggaacgctgagttatatagtttaatggggaagtttgcgttttggacaatcttttgtaccaacgtaaacgcctcttcaagtgaaggatttttgattggcataaattggttaaatagaacccgtaatgagattgacggtaaaaccatgcatgccaactatttgttttggagaaatagtacaatgtggaatggaggggcttatagtctttttgatatgactaagttccctttgaaagcggctggtacggctgttgttagccttaaaccagaccaaataaatgacttagtcctctccttgattgagaagggcaagttattagtgcgtgacacacgcaaagaggtttttgttggcgatagcctagtaaatgttaaataa

SEQ ID NO: 36 - DNA, 31276 bp, Coronavirus
ataagagtgattggcgtccgtacgtaccctttctactctcaaactcttgttagtttaaatctaatctaaactttataaacggcacttcctgtgtgtccatgcccgtgggcttggtcttgtcatagtgctgacatttgtggttccttggtttttgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtagccctgagaggtcagaggaggatgggttttgcccctctgctgcgcaagaaccaaaaactaaaggaaaaactttgattaatcacgtgagggtggattgtagccggcttccagcattggagtgctgtgttcagtctgccataatccgtgatatttttgttgatgaggatcccttgaatgtggaggcctcaactatgatggcattgcagttcggtagtgctgtcttggtcaagccatccaagcgcttgtctattcaggcatgggctaagttgggtgtgctgcctaaaactccagccatggggttgttcaagcgcttctgcctgtgtaacaccagggagtgcgtttgtgacgcccacgtggcttttcaactttttacggtccagcctgatggtgtatgcctgggcaatggccgttttataggctggtttgtgccagtcacagccataccggcgtatgcgaagcagtggttgcaaccctggtccatccttcttcgtaagggtggtaacaaagggtctgtaacatccggccatttccgccgcgctgttaccatgcctgtgtatgactttaatgtggaggatgcttgtgaggaggttcatcttaacccgaagggtaagtactcccgcaaggcgtatgctcttcttaagggctatcgcggtgttaaatccatcctattcttggaccagtatggttgtgactatactgggcgtctcgccaagggtcttgaagactatggcgattgtactttggaagagatgaaggagttgtttcctgtgtggtgtgactccttggataatgaagttgttgtggcctggcatgttgatcgggatcctcgggctgttatgcgcttgcagactcttgctactatacgtagcattggttatgtgggccaaccgaccgaggatttggttgatggagatgtggtagtgcgtgagcctgctcatctcctagcagccaatgccatcgtcaaaaggctcccccgcctggtggagactatgctgtatacggactcttccgttacagaattttgttataaaactaagttgtgtgattgtggttttatcacgcagtttggttatgtggattgctgtggtgatgcctgcgattttcgtgggtgggttcctggcaatatgatggatggctttctttgccccggatgtagtaagagctatatgccctgggaattggaggctcaatcatctggtgtgattccaaaaggtggtgttctatttactcagagcactgacacggtgaatcgtgagtcatttaagctctacggtcatgccgttgtgccttttggttctgctgtgtattggagcccctacccaggtatgtggcttccagttatttggtcttctgttaagtcatatgctgatttgacttacacaggcgttgttggttgtaaggcaattgttcaggagacagatgctatttgccggtccctatatatggactacgttcagcacaagtgtggcaatctcgagcagagagctattcttgggttggatgatgtctaccatagacaattgcttgtaaatagaggtgactatagtctcctccttgaaaatgtagatctttttgttaagcggcgcgctgaatttgcttgtaaattcgccacctgtggagatggtcttgtacctctgctactagatggtttggtgccccgcagttattatttgattaagagtggccaagccttcacctcgatgatggttaattttagccatgaggtgactgacatgtgtatggacatggcattattgttcatgcatgatgttaaagtggccactaagtatgttaagaaggttactggcaaactagccgtgcgctttaaggcgttaggtgtagccgttgtcaggaaaattactgaatggtttgatcttgccgtggacactgctgccagtgctgctggatggctttgctaccagctggtaaatggcttatttgcagtggctaatggtggcataaccttcttaagcgatgttcctgagctggtcaagaattttgttgacaagttcaaggtattcttcaaggttttgatcgactctatgtcggtttctgtcctttctggacttactgttgtcaagactgcctctaatagggtttgtcttgctggctgtaaggtttatgaagttgtgcagaagcgtttgtctgcatatgttatgcctgtgggttgcaacgaggccacttgtttagtgggtgagattgaacctgcagttgttgaagatgatgttgttgatgtggttaaagccccattaacatatcaaggctgttgtaagccacctacttcttttgagaagatttgtgttgtggataaattgtatatggccaagtgtggtgatcaattttaccctgtggttgttgataatgacactattggcgtgttagatcagtgttggaggtttccctgcgcaggcaagaaagtcgagtttaacgacaagcctaaagtcaaggagataccctccacgcgaaagattaagatcaactttgcgttggatgcgacttttgatagtgtcctttcgaaggcgtgttcagagtttgaagttgataaagacgttacattggatgagctgcttgatgttgtgcttgatgcagttgagagtacgctcagcccttgtaaggagcatgatgtgattggcacaaaagtttgtgctttacttaataggttggcagaagattatgtctacctctttgatgagggaggcgaggaagtgattgccccaaagatgtattgttccttttctgctccagatgatgaagactgcgtcgcagcggatgttgtggatgcagatgaaaaccaaggtgacgatgctgacgattctgcagcccttgtcaccgatacccaagaagaggacggtgttgccaaggggcaggttggtgtggctgagtcggatgcccgcctcgatcaagttgaggcatttgatattgaaaaggttgaggatcccatcttgaatgagctctcggctgaacttaatgcgccagcagacaagacctatgaggatgttttggcatttgatgccatttattcagaggcattgtctgcattctatgctgtgccaggtgatgaaacgcactttaaggtgtgtggattctattcgccagctatagagcgtactaattgttggctgcgttctactttgatagtaatgcagagcttacctttagaatttaaagatttggagatgcagaagctctggttgtcgtacaaatccagttataataaggaatttgtcgacaaactagttaagagcgtgcccaagtctatcattcttccacaaggtggctatgtggcagattttgcctacttctttttaagccagtgtagctttaaagcttatgctaactggcgctgtttaaagtgtgacatggacttaaagcttcaaggcttggatgccatgttcttttatggagatgtagtatcccatgtgtgtaagtgtggtactggcatgaccttgttgtctgcagatataccttacactttgcatttcggattgcgagatgataaattttgcgccttttacacgccaagaaaagtctttagggctgcttgtgtggtagatgttaatgattgtcattccatggctgttgtggatggcaagcaaattgatggtaaagttgttaccaaatttaatggtgacaaatatgattttatggtgggtcatgggatggcatttagtatgtcagcctttgagattgcccagttatacggttcatgtataacaccaaatgtttgttttgttaaaggagatgttataaaggttttgcgcagagtgggtgctgaagtcatcgttaaccctgctaatgggcgtatggctcatggtgcgggtgttgcaggtgctatagctaaagctgcgggcaaatcttttattaaggagactgctgatatggtaaagaatcagggcgtttgccaggttggtgagtgctatgaatctaccggcggcaatttatgtaagacggtgcttaacattgtaggaccagatgcccgagggcatggcaagcaatgttactcatttttagagcgtgcttatcagcatattaacaagtgtgacgatgttgttaccactttaatatcagctggtatatttagtgtgcctactgatgtttctctgacttatttaattggtgttgtgactaagaatgttattcttgtcagcaacaacaaagatgattttgatgttatagagaagtgtcaagtgacttccattgctggcactaaagcgctctcacttcaattggctaaaaatttgtgccgagatgtaaagtttgagacaaatgcatgtgattcgctttttagtgactcctgcttcgtctcaagctatgatgtgttgcaggaggttgaattgctgcgacatgacatacagttggatgatgatgcccgtgtctttgtgcaggcccatatggacaacctgcccgctgactggcgtctcgttaataagtttgatagtgttgatggtgttagaaccgttaaatattttgagtgtccgggtgagatttttgtatctagccagggcaagaagtttggttatgttcagaatggttcatttaaagtggcaagtgttagccaaataagggctttacttgctaataaggtggatgtcttgtgcaccgttgatggtgttaacttccgctcgtgctgtgttgcagagggtgaagtttttggcaagacattaggttcagtcttttgtgatggcataaatgtcaccaaggttaggtgtagtgccattcacaagggtaaggtcttctttcagtatagtggtctgtctgcggcagatctcgttgctgttacggatgcctttggctttgatgaaccacagctgctgaagtactacaatatgctaggcatgtgtaagtggccagtagttgtttgtggcaattattttgcttttaagcagtcaaataataattgctatataaatgtggcatgtttaatgctgcaacatttgagtttaaagtttcataagtggcaatggcaggaggcctggaatgagttccgctctggtaagccactaaggtttgtgtccttggtcttggcaaagggcagctttaaatttaatgaaccttctgattcaactgattttatgcgtgtggtgctgcgcgaagctgatttgagtggtgccacatgcgattttgaatttgtttgtaaatgtggtgtaaagcaagagcagcgcaaaggtgttgacgctgttatgcattttggtacgttggataaaggtgatcttgccaagggttacactatcgcatgcacgtgcggtaataaacttgtgcattgcacccaacttaacgtaccatttttaatttgctccaacaagcctgagggtaagaaattgcctgatgatgttgttgcggctaatatttttactggtggtagtttgggacactacactcatgtgaaatgcaaacccaagtaccagctttatgatgcttgtaatgttagtaaggtctctgaggctaagggtaattttaccgattgcctctaccttaaaaatttaaaacaaactttttcgtccaagttgacgactttttatttagatgatgtaaagtgcgtggagtataatccggatttatcgcagtattactgtgagtctggaaaatattatacaaagcccatcattaaggcccagtttagaacatttgagaaggtagagggtgtctataccaattttaaattggtggggcacagcattgccgaaaaattcaatgctaagctgggatttgattgtaattctccctttacggagtataaaattacagagtggccgacagctactggagatgtggtgttggctagtgatgatttgtatgtgagccgttattcaggtggatgtgttacttttggtaagccggttatctggttgggccacgaggaagcatctctgaaatcgctcacatattttaatagacctagtgtcgtttgtgaaaataaatttaatgtgttgcctgttgatgtcagtgaacccacggataaggggcctgtgccggctgcagtccttgttaccggtgctctgagtggtgctgccactgcgcccggtactgccaaggagcaaaaggtgtgcgcttctgatagtgtggtggatcaggttgtctcggggttcttatcagacctgtctggtgcaaccgtggatgtcaaagaggttaaattgaatggtgttaaaaagcctattaaggtggaagatagtgtggttgttaatgaccccactagcgaaaccaaagttgttaaaagtttgtctattgtcgatgtgtatgatatgttcctgacagggtgtagatatgtggtctggatggctaatgagttgtcccggctagtaaattcacctactgttagggagtatgtgaagtggggtatgactaagattgtaatacccgctaaattggtgttgttaagagatgagaagcaagaatttgtagcgccaaaagtagtcaaggcgaaagttattgcctgctatagtgctgtgaagtggttcttcctctattgttttagttggataaagtttaatactgataataaggttatatacaccacagaagtagcttcaaagcttacttttaatctgtgctgtttggcgtttaagaatgccttacagacttttaattggaacgttgtgtctaggggcttcttcctagtggcaacggtctttttattatggtttaactttttgtatgccaatgttattttgagtgatttctatttgcctaatattggtttctttcctacatttgtgggtcagattgtcgcttgggttaagaccacatttggtatttttaccctctgtgatctttatcaggtgtcagatgttggctatagaagttctttttgtaatggaagtatggtctgcgaactatgcttttcaggttttgacatgttggataactatgatgctataaatgttgttcagcatgttgtggataggcgagtgtcttttgactatattagcctatttaagttagtggtcgagcttgttatcggctactctttgtataccgtgtgtttctatccactgtttggccttattggcatgcagttgctgaccacatggttaccagaattctttatgctggaaactatgcattggagcgcgcgcttctttgtgtttgttgctaatatgcttccagcttttacgttactgcggttttatatcgtggtaacagctatgtataagatcttttgtctttgtagacatgttatgtatggatgtagtagaccaggttgtttgttttgctataagagaaaccgtagtgtccgtgttaagtgtagcactgttgttggtggtacgctacgctattacgatgtaatggctaatggcggcactggtttctgtgcaaagcatcagtggaactgtcttaattgcagcgcttttggacctggcaacacattcataactcatgaagcagcggcggatctctctaaagaattgaagcgccctgttaatccaacagattctgcttactatttggtcacagaggttaagcaggtaggttgttcaatgcgtctgttctacgagagagatggacagcgcgtttatgatgatgttagtgctagtttgtttgtggatatgaatggtctgctgcattctaaggttaaaggtgtgccagaaacacatgttgtagttgttgagaacgaagctgataaggcaggttttcttaatgctgctgttttctacgcacaatccctttatagaccgatgttgctggtagagaagaaattaataactaccgccaacacgggcttgtctgtgagtcagactatgtttgacctttatgtagactcactgctgggcgtcttggacgttgatcgcaagagtctaacaagttttgtgaatgctgcgcacaattccttaaaggagggtgtgcagcttgaacaagttatggatacctttattggttgcgctcgacgtaagtgtgctatagattcagatgttgagaccaagtctattaccaagtccatcatgtcggcagtaaatgctggtgttgattttacggatgagagttgtaacaacttggtacctacatatgtgaaaagcgacactatcgtcgcagccgatttgggtgttcttattcagaataatgctaagcatgtacaggctaatgttgctaaagctgctaatgtggcttgcatctggtctgtggatgcttttaatcagctatctgctgatctgcagcataggctgagaaaggcatgttcaaaaactggcttgaagattaagcttacttataataagcaggaggcaaatgtccctattttaactacaccgttctctcttaaagggggcgctgtgtttagtaaagttttgcaatggttgtttgttgttaatttgatttgtttcattgtactgtgggctcttatgccgacatatgcagtgcacaaatcagatatgcagttgcctttatatgccagttttaaagttatagataatggtgtgctaagggatgtgaccgttacggatgcatgctttgcaaacaaatttattcaatttgatcaatggtatgagtctacgtttggtcttgtctattaccgtaactctagggcgtgtcctgttgtggttgctgtcatagaccaagatattggctataccttatttaatgttcctactaaagtcttaagatatggatttcatgtgttgcattttataacccatgcatttgctactgatagcgtgcagtgttatacgccacatatgcaaatcccctatgataatttctatgctagtgggtgtgtcttgtcttccctctgtactatgctagcgcatgcagatggcacaccgcatccttattgctatacagagggcattatgcataatgcatctctgtatgactctttggctcctcatgttcgttataacctagctaattcaaatggttatatacgctttcctgaagtggttagtgaaggcattgtgcgtattgtgcgcactcgctccatgacctactgcagggttggcttatgtgaggatgctgaggagggtgtttgttttaactttaatagttcttgggtattgaataacccgtattatagggctatgcctggaactttttgtggtaggaatgcttttgatttaatacaccaagttttaggaggtttagtgcggcccattgacttctttgccctaacggcgagttcagtggctggtgctatcctagcaattattgttgttttagctttttattatttaataaagcttaaacgtgcctttggtgactatactagcgttgtggtcatcaatgtcattgtgtggtgtataaatttcctgatgctatttgtgtttcaggtttatcccactttatcttgtttatatgcttgtttttatttttacacgacgctttatttcccctcggagataagtgttgttatgcatttgcaatggctagtcatgtatggtgctattatgcccttgtggttttgcattatatacgtggcagttgttgtttcaaaccatgcattgtggctgttctcttactgccgtaagcttggtacagaagttcgtagtgatggtacatttgaggagatgtcccttactacttttatgattactaaagaatcctattgtaagttgaaaaattctgtttctgatgttgcttttaacaggtacttgagtctctataacaagtatcggtattttagtggtaaaatggataccgcggcctatagagaggctgcttgttctcaactagcaaaggcgatggaaacatttaaccataataatggtaatgatgttctctatcagccacctacggcctctgttactacatcatttttacagtccggtatagtgaagatggtgtttcccacctctaaggtggaaccttgtgttgttagtgtcacctatggtaacatgacacttaatgggttgtggttggacgataaagtttattgtccaagacatgtcatctgctcctcagctgacatgacagaccctgattattctaatttgctttgtagagtgatatcaagtgatttttgtgttatgtctggtcgtatgagccttactgttatgtcttatcaaatgcagggcagtctacttgttttgactgttacactgcaaaatcctaacacacctaagtactccttcggtgttgttaagcctggtgagacgtttactgttttggctgcatacaacggcaaatctcaaggagccttccatgttactatgcgtagtagctataccataaagggctccttcttgtgtggatcctgcggttctgtaggatatgttttaacgggcgatagtgtacgatttgtctacatgcatcagctagagttgagtactggttgtcacaccggtactgactttagtgggaacttttatggtccctatagagatgctcaagtcgtacaattgcctgttcaagattatacgcagactgttaatgttgtagcttggctttacgctgctattcttaatagatgcaattggtttgtgcaaagtgatagttgttccctggaagagtttaatgtttgggctatgaccaatggttttagttcaattaaagccgaccttgttctagatgctcttgcgtctatgacaggtgttacagttgaacagatcttggctgctattaagcggctgtattctggctttcagggtaaacaaattttaggtagttgtgtgcttgaggatgagctgacgccaagcgatgtttatcaacaactagctggtgttaagttacagtcaaagcgcacaagagttgttaaaggtacatgttgctggatattggcttcaacattattgttttgtagcattatctcagcatttgtaaaatggactatgtttatgtatgttactacccatatgttgggtgtgacattgtgtgcactttgctttgtgagctttgctatgctgttggttaagcataagcatttgtatttaactatgtttattatgccggttttgtgcacattgttttacacgaactatttagttgtgtataaacagagttttagaggcctagcttatgcatggctttcacactttgtccctgctgtagattatacatacatggatgaagttttatatggtgtcgtgttgctagtagctatggtttttgttaccatgcgcagcataaatcacgatgtcttctctgttatgttcttggttggtagacttgtcagcttggtgtctatgtggtactttggggccaatttagaggaggaggtgctattgttcctcacatcactctttggcacgtatacatggactactatgctgtcattggctactgctaaggtcattgctaaatggttggctgtgaatgtcttgtacttcacagacgtaccgcaagttaaattagttcttttgagctatttgtgtattggttatgtgtgttgttgttattggggcgtcttgtcactccttaatagcatttttaggatgccgttgggtgtctataattataaaatctccgtgcaggagttacgctatatgaatgctaatggcttgcgcccgcccagaaatagttttgaagccctagtgcttaattttaaattgttgggaattggtggtgtgccagtcattgaagtatctcaaattcaatcaagattgactgatgttaaatgtgttaatgttgtgttgcttaactgcctccagcacttgcatattgcatctagttctaagttgtggcagtattgcagtactttgcataatgaaatattagctacatctgatttgagcgtggcctttgataagttggctcagctcctagtagtcttatttgctaatccagcagcagtggatagcaagtgtcttgcaagtattgaagaggtgagcgatgattacgttcgcgacagtactgtcttgcaagccctacagagtgaatttgttaatatggctagcttcgttgagtatgaacttgctaagaagaatttagatgaggccaaggctagcggctctgccaatcaacagcagattaagcaactagagaaggcttgtaatattgctaagtcagcatatgagcgcgacagagctgttgctcgcaagcttgaacgtatggctgatttggctcttacaaatatgtataaagaagctagaattaatgataagaagagtaaggtagtttctgcattgcaaaccatgctttttagtatgattcgtaagctggataaccaagctcttaattctattttagataatgcagttaagggttgtgtacctttgaatgcaataccatcattgacttcaaacactctgactataatagtgccagataagcaggtttttgatcaagttgtggataatgtgtatgtcacctatgctgggaatgtatggcatatacaatctattcaggatgctgatggcgctgttaaacaattgaatgagatagatgttaatataacctggcccctagtcattgctgcaaataggcataatgaagtgtctagtgttgttttgcagaacaatgagttgatgcctcagaagttgagaacgcaggttgtcaatagtggctcagatatgaattgtaatactcctacccagtgttattataatacgactggcatgggtaagattgtgtatgctatacttagtgactgtgatggtcttaagtacactaagatagtaaaagaagatggaaattgtgttgttttggagttggatcctccctgtaaattttcagttcaggatgtgaaggggcttaaaattaagtacctttactttgtgaaggggtgtaatacactggccagaggctgggttgttggcaccttatcctcgacagtgaggttgcaggcaggtacggcaactgagtatgcctccaactctgcaatacggtcgttgtgtgcgttttctgtagatcctaagaaaacgtacctggactatatacaacagggtggagctcccgttactaattgtgttaagatgttatgtgaccatgctggcactggtatggccattactattaagccggaggcaaccactaatcaggattcttatggtggtgcttccgtttgtatatattgccgctcgcgtgttgaacatccagatgttgatggattgtgcaaattacgcggcaagtttgtccaagtgcccttaggtataaaggatcctgtgtcatatgttttgacacatgatgtttgtcaggtctgtggcttttggcgagatggtagctgttcctgtgtaggcacaggctcccagtttcagtcaaaagacacgaactttttaaacgggttcggggtacaagtgtaaatgcccgtcttgtaccctgtgccagtggcttggacactgatgttcaattaagggcatttgatatttgtaatgctaatcgagctggcattggtttgtattataaagtgaattgttgccgttttcagcgcgcagatgaagatggcaacacgttggataagttctttgttattaaaagaaccaatttagaagtgtataataaggagaaagaatgctatgagttgacaaaagaatgtggtgttgtggctgaacacgaattcttcacattcgatgttgagggaagtcgtgtaccacacattgtacgcaaagatctttcaaagtatactatgttagacctttgctatgcattgcggcatttcgatcgcaatgattgttcaactctcaaggaaattctccttacttatgctgagtgtgatgagtcctactttcagaagaaggactggtatgattttgttgagaattctgatataattaatgtgtacaaaaagcttggacctatttttaatagggccttgcttaacactgctaagtttgcggacacattagtggaggcaggcctagtaggtgttttaacacttgataatcaagatttgtatggtcaatggtatgactttggagattttgtcaagacagtgcctggatgtggtgttgccgtggcagattcctattattcttatatgatgccaatgctgactatgtgtcatgcgttggatagtgagttgtttattaatggtacttatagggagtttgaccttgttcagtatgattttactgatttcaagttagagctctttaataagtattttaagtattggagtatgacctatcacccgaacacctgtgagtgcgaggatgacaggtgcattattcattgcgccaattttaatatactatttagtatggttttacctaagacctgttttgggcctcttgttaggcaaatctttgtagatggtgtgcctttcgttgtctcgattggctaccattataaagaattaggtgttgttatgaatatggatgtggatacacatcgttaccgcttgtctcttaaagacttgcttttgtatgcagcagatcctgcccttcatgtggcgtctgctagtgcactgcttgatttgcgcacatgctgttttagcgtagcagctattacaagtggcgtaaaatttcaaacagtcaaacctggaaattttaatcaggatttttatgagtttattttgagtaaaggcctgcttaaagaagggagctccgttgatttgaagcacttcttctttacgcaggatggtaatgctgctattactgattataattattacaagtataatctccccactatggtggatattaagcagttgttgtttgttctagaagttgttaataagtattttgagatctatgatggtgggtgtatacccgcaacacaggtcattgttaataattatgataagagcgctggctatccatttaataaatttggaaaggccagactctattatgaggcattatcatttgaggaacaggatgaagtttatgcgtacactaagcgcaacgtcctgccaacattaactcaaatgaatcttaaatatgctattagtgctaagaatagggctcgcactgttgctggtgtttccattcttagtactatgactggcagaatgtttcatcaaaagtgtttaaagagtatagcagctactcgtggtgttcctgtagttataggcaccacgaaattttatggcggttgggacgatatgttacgccgccttattaaagatgttgatagtcctgtacttatgggttgggactatcctaaatgtgatcgtgctatgccaaacatactgcgcattattagtagtttggtgttagcccgcaaacatgattcgtgctgttcgcatacagatagattctatcgtcttgcgaatgagtgcgcccaagttttgagtgaaattgttatgtgtggtggttgttattatgttaaaccaggtggcactagcagtggggatgcaaccactgcctttgctaattctgtttttaacatttgtcaagctgtctccgccaatgtgtgctcgcttatggcatgcaatggacacaaaattgaagatttgagtatacgcgagttacaaaagcgcctatactctaatgtgtatcgtgcggatcatgttgaccccgcatttgttaatgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggctaaatgttgggtcgaaacagacatcgaaaagggaccacatgaattttgttctcaacacacaatgctagtaaagatggatggtgatgaagtctaccttccatatcctgatccttcgagaatcttaggagcaggctgttttgttgatgatttattaaagactgatagcgttctcttgatagagcgattcgtaagtcttgcaattgatgcttatcctttagtataccatgagaacccagagtatcaaaatgtgttccgggtatatttagaatatataaagaagctgtacaacgatctcggtaatcagatcttggacagctacagtgttattttaagtacttgtgatggtcaaaagtttactgatgagaccttttacaagaacatgtatttaagaagtgcagtgatgcaaagcgtcggtgcctgcgtcgtctgtagctcccaaacatcattacgctgtggcagttgcatacgcaagccattgctgtgttgcaagtgcgcttatgatcatgttatgtctactgatcataaatatgtcctgagtgtgtcaccttatgtgtgtaattcgccgggatgtgatgtaaatgatgttaccaaattgtatttaggtggtatgtcatattattgtgaggaccataagccacagtattcattcaagttagtgatgaatggtatggtttttggtctatataaacaatcttgtactggttcgccctacatagaagattttaataaaatagctagctgtaaatggacagaagtcgatgattatgtgctagctaatgaatgtaccgagcgtctcaaattgtttgccgcagaaacgcaaaaggccactgaagagtcctttaagcaatgttatgcgtcagcaacgatccgtgagatcgtgagcgatcgggagttaattttatcttgggaaattggtaaagtgaggccaccacttaataaaaattatgtttttactggctaccattttacttctaatggtaagacagttttaggtgaatatgtttttgataagagtgagttgactaatggtgtgtattatcgcgccacaaccacttataagttgtctgttggtgatgtttttattttaacatcacatgcagtgtctagtttaagtgctcctacattagtaccgcaggagaattatactagcattcgctttgctagtgtttatagtgtgcctgagacgtttcagaataatgtgccaaattatcagcacattggaatgaagcgttattgtactgtacagggacctcctggtactggaaagtcccatctagccattgggctagctgtttattattgtacagcgcgtgtggtgtataccgctgctagccatgctgcagttgacgcgttgtgtgaaaaggcatataaatttttaaatattaatgactgcacgcgtattgttcctgcaaaggtgcgtgtagattgttatgataaatttaaggtcaatgacaccactcgtaagtatgtgtttactacaataaatgcattacccgagttggtgactgacattattgttgttgatgaagttagtatgcttaccaattatgagttgtctgttattaacagtcgtgttagggctaagcattatgtttatattggagatcctgctcagttgcccgcaccccgtgtgctactgaataagggcactctagaacctagatattttaattctgttaccaagctaatgtgttgcttgggtccagatattttcttgggtacctgttatagatgccctaaggaaattgtggatacagtgtcagccttggtttatcataataagctgaaggctaaaaatgataatagctccatgtgttttaaggtctattataaaggccagactacacatgagagttctagtgctgtcaatatgcagcaaatatatttaattagtaagtttttaaaggcaaaccccagttggagtaacgccgtatttattagtccttataatagtcagaactatgttgctaagagagtcttgggtttacaaacccagacagtagattcagcgcagggttctgaatatgattttgttatttattcacagactgcggaaacagcgcattctgtcaatgtaaatagattcaatgttgctattacacgtgctaagaagggtatcctctgtgtcatgagtagtatgcaattatttgagtctcttaattttagcacactgactctggataagatcaataatccacgattacagtgtactacaaatttgtttaaggattgtagcagaagctatgcaggttatcacccagctcatgcgccttcctttttggcagttgatgataaatataaggtaggtggcgatttagccgtttgccttaatgttgctgattctgctgtcacttattcgcggcttatatcactcatgggattcaagcttgacttgacccttgatggttattgtaagctgtttataactagagatgaagctatcagacgtgttagagcctgggtaggctttgatgcagaaggtgcccatgcgacgcgtgatagcattgggacaaatttcccattacaattaggcttttcgactggaattgattttgttgtcgaggccactggaatgtttgccgagagagatggctacgtctttaaaaaggcagtggcacgagcacctcccggcgaacaatttaaacacctcgtcccacttatgtctagaggacagaaatgggacgtggttcgaattcgaatagtacaaatgctgtcagaccacttagtggatttggcagacagtgttgtacttgtgacgtgggctgccagcttcgagctcacatgtttgcgatatttcgctaaagttggaaaagaagttgtgtgtagtgtctgcaacaagcgtgcgacatgttttaattctaggactgggtactatggatgctggcgacatagttattcctgtgattacctgtataacccactaatagttgatattcaacagtggggatatactgggtctttaactagcaatcatgacctcatttgcagcgtgcataagggtgctcatgtcgcatcttctgatgctatcatgacccgatgcttagctgtccatgattgcttttgcaaatctgttaattggagtttagaataccccattatctcaaatgaggttagtgttaatacctcctgcaggttattgcagcgtgtaatgtttagggctgcgatgctatgcaataggtatgatgtgtgttatgacattggcaaccctaaaggtcttgcctgtgtcaaaggctatgattttaagttttatgatgcctctcctgttgttaagtctgttaaacagtttgtttataagtatgaggcacataaagatcaatttttagatggtttatgtatgttttggaactgcaatgtggataagtatcccgcgaatgcagttgtatgtaggtttgacacgagagtgttaaacaaattaaatctccctggctgtaatggtggtagtctgtatgttaataaacatgcattccacaccagtccctttacgcgggcagccttcgagaatttgaagcctatgcctttcttttattactcagatacgccttgtgtgtatatggagggcatggagtctaagcaggtcgattatgtcccattgagaagcgccacttgcattacaagatgcaatttaggtggcgctgtttgtttaaaacatgctgaggattatcgtgagtaccttgagtcttacaatacggcaaccacagcgggttttaccttttgggtctataagacttttgatttttacaacctttggaatacttttactaggctccaaagtttagaaaatgtagtgtataatttggtaaatgctggacactttgatggacgggcgggtgaactgccttgtgccgttataggtgagaaagtcattgccaagattcaaaatgaggatgtcgtggtttttaaaaataacacgccattccctactaatgtggctgttgaattatttgctaagcgcagtattcgaccacacccagagcttaagctctttagaaatttgaatattgacgtgtgctggagtcacgtcctttgggattatgctaaggatagtgtgttttgcagttcgacgtacaaggtctgcaaatacacagatttacagtgcattgaaagcttgaatgtactttttgatggtcgtgataatggtgctcttgaagcttttaagaagtgccgggatggcgtctacattaacacgacaaaaattaaaagtctgtcgatgattaaaggcccacagcgtgccgatttgaatggcgtagttgtggagaaagttggagattccgatgtggaattttggtttgctatgcgtagagacggtgacgatgttatcttcagccgtacagggagccttgaaccgagccattaccggagcccacaaggtaatccgggtggtaatcgcgtgggtgatctcagcggtaatgaagctctagcacgtggcactatctttactcaaagcagatttttgtcctctttcgcacctcgatcagagatggagaaagactttatggatttagatgaagacgtgttcattgcaaaatatagtttacaggactacgcgtttgaacatgttgtttatggtagtttcaaccagaagatcattggaggtttgcatttgcttattggcttagcccgtaggcagcaaaaatccaatctggttattcaagagttcgtcccgtacgactctagcatccactcgtactttatcactgacgagaacagtggtagcagtaagagtgtgtgcactgttattgatttgttgttagatgattttgtggacattgtaaagtccctgaatctaaattgtgtgagtaaggttgttaatgtgaatgttgattttaaagatttccagtttatgttgtggtgcaatgaggagaaggtcatgactttctatcctcgtttgcaggctgccgctgattggaaacctggttatgttatgcctgtattatacaagtacttggaatcgccgctggaaagagttaatctctggaattatggcaagccgattactttacctacaggatgtttgatgaatgttgctaagtatactcaattatgccaatatttgaatactacaacattagcagtcccggctaatatgcgtgttttacacctcggagccggttctgataaggatgttgcccctggatctgcagttcttaggcagtggttaccagcaggcagcattcttgtagataatgatataaatccatttgtgagtgacagtgttgcctcatattatggaaattgtataaccttacccatagcgtgtcagtgggatttgataatttctgatatgtacgaccctcttactaagaacattggggagtacaacgtgagtaaagatggattctttacttacctttgtcatttaattcgtgacaagttggctctgggtggcagtgtcgccataaaaattacagagttttcttggaacgctgagttatatagtttaatggggaagtttgcgttttggacaatcttttgcaccaacgtaaacgcctcttcaagtgaaggatttttgattggcataaattggttaaataggacccgtaccgagattgacggtaaaaccatgcatgccaattatttgttttggagaaatagtacaatgtggaatggaggggcttacagtctttttgatatgagtaagttccctttgaaggtggctggtacggctgttgtaagcctaaagccagaccaaataaatgatttagtcctctccttgattgagaagggcaagttattagtgcgtgatacacgcaaggaagtatttgttggcgatagccttgtaaatgttaaataaatctatacttgtcatggctgcgatgcaggcctttgctgacaagcctaatcattttataaacttcccattggcccaatttagtggcgttatgggtaagtatttaaagcttcagtcgcaacttgtggaaatgggtttagactgtaaattacagaaagcaccacatgttagtattaccatgctcgatattagagcagatcaatacaaacaggtggaatttgcaatacaagaagtaatagatgatatggcggcatatgagggagatattgtctttgacaaccctcacatgcttggcagatgtcttgttcttgatgttaaaggatttgaagagttgcatgaagatatagttgaaattctccggaaaaggggttgcatagcagatcaatccagacaatggattcctcactgtactgtggcccaatttgaggaagaaaaagaaataaatgagctgcaattctattataaattacccttctacctcaagcataacaacatattaacggatgctaggcttgagcttgtgaagataggttcttccaaaacagatgggttctattgtagtgagctgagcatttggtgtggtgagagactttgttacaagcctccaacacccaaatttagtgatatatttggctattgctgcattgataaaatacgtgttgacttagaaattggtgacctacccgaggatgatgaagaagcgtgggccgagctaagttaccactatcaaagaaacacctacttcttccgctacgtacatgataatagcatttattttcgtaccgtatgcagaatgaagggttgtatgtgttgatttggttttacactagtagtgtaataaacttattattttattgaaacaggcagtatgtgcatggctatggctccccgcactctgcttttgctgattggatgtcagctggtgtttgggttcaatgaacctttaaacaccgtttcacattcaaatgatgattggtttttgtttggtgacagtaggtctgactgcaaccatataagtagcctttctcagcagaattataagtatatggatattaacccagaattgtgtaagtcggggaagatttcttctaaggcgggtaattccctctttagaagttttcatttcaccgatttctacaattatagtggcgaaggttcataaatcatattttatgaaggagttaattttaccccatatgttgggtttaagtgtatgaataatggggataataataggtggatgggtaataaagctcgattttatacccaattgtatcagaagatggctcattatcgtagcctatctataattaatgttacttacacatataatggtaatgctactcccgttgctatgtgtaagcacactgctaatggtgtcacattgaccctaaccctaccttcattggtaaggagacaagtgcacctaattattattatgagagcgaggcaaactttacgttgcatggatgcgatgagtttattgtcccgctctgcgtctttaatggccagtatttatctagtaaactgtattatgatgatagtcagtattattataatattgatacaggcattttatatgggtttaattccaccttgaatattaccactgggttggacttaacctgtatctatctttcattagctcctggtaattataaggccattttaaatgaattattgttaactataccctctaaggctatttgcctgcgtaagcctaaggtgtttacgcttgtgcaagtagttgattctagatggcatagtaataggcaatctgacaatatgactgctattgcgtgtcagctgccatattgttatttccgtaatgccagtaatgattacaatggcatttatgattctcaccatggcgatgctggatttactagcatcttgtctggtttgttatataatgtttcctgtattgcccagcagggtgcatttctttataataatgttagcgcctcttggccagtttttggctacggccattgtccaacggcagctaacattggatatatggcacctgtttgtatgtatgatcctttaccggtcatattacttggtgtcttactgggtatagctgtgttaattattatttttcttattttgtattttatgacggatagcagtgttaggttgcatgaggcctaagtgtttcggaaaatctaaacatgctattcgtgtttttaaccttgttgccctcttctctagggtatattggtgattttagatgtatccaacttgtaaataccgacacctctaatgccagcgctccaagcgttagtacagaggtagttgatgtttccaaagggattggtacttattatgttttagatcgagtctatttaaatgccacactattgcttactggttattaccctgtagatgggtccatgtatagaaacatggctctaacgggaattaataccataagccttaattggtacaaaccaccctttttatcagagtttaatgatggcatatttgctaaggtaaagaaccttaaagcatctttgcccaaagattctatttcatatttccctactataattataggtagtaattttgtcaccacttcctatactgtagtattggaaccgtataatggtataattatggcatccatttgccagtataccatttgtcaactaccgtacacggattgcaaaccgaatacgggcggtaataagttaattggcttttggcacacagagctaaaatcccctgtgtgcattttaaagcgtaattttacgtttaatgttaatgccgaatggctttattttcatttttaccagcagggtggtactttttatgcgtattatgcggatgtttcttctgctactacgtttttgtttagtatgtatattggtgatgtgttaacacaatattttgtgttgccttatatgtgtactctcactacaacaggtgtcttttcaccgcagtattgggttacacctcttgtcaagcgccaatatttatttaattttaatcaaaagggtattattactagtgctgttgattgtgctagtagttataccagcgaaataaagtgtaagacccaaagtatgaatcccaatacgggagtttatgatttatccggttacaccgtccaacctgtaggattagtgtaccggcgtgttagaaatttgcctgattgtaaaattgaggaatggctaactgctaagtctgtaccttctcctctcaattgggagcgcaaaacatttcaaaattgtaacttcgacctgagcagtctattaagatttgttcaggctgagtcactctcatgtagtaatatagatgcttccaaggtttatggtatgtgctttggtagtatatctatagacaagtttgcgatacccaatagacgccgagttgatttgcagctaggcaactctgggtttttgcaatcctttaattacaaaatagatacaagagctacttcgtgtcagctctattatagtcttgcaaaaaataatgtcactgtcaataaccataacccgtcctcttggaacaggcgttatgggttcaatgatgtggctacatttggaactggtaaacatgacgttgcttatgctgaggcttgttttaccgtgggagcatcatattgcccttgcgcgaaccccagcatagtgtcgccatgtaccactggaaaacctaactttgccaattgccctacaggcacctcgaatcgtgagtgcactgttatgccattggctaataatcaatttaagtgtgattgcacttgtaaccctagtcctctaaccacctatgatcttagatgtctccaagcaagaagcatgcttggcgtaggtgatcattgtgaaggtctaggagttttagaagataaatgtggtggcagcaacacctgcaattgttctgctcatgcctttgttggctgggctaaggatagttgcttggctaatggccgctgtcacatttttagtaatttgatgttaaatggcattaatagtggtactacatgttccatggatttgcaattgcctaatactgaagtggtcactggcgtctgcgtcaaatatgacctctacggtataacaggccaaggtatttttaaggaggttaaggctgactattatcatagttggcaaaacctcttatatgatgttaatggcaacttaatcggatttcgcgattttgttgctaataagagttatactattcgaagttgctatagtgggcgggtctcggctgcatatcatcaagatgcaccagaaccagcgctactatatcgcaatttaaaatgtgactatgtctttaacaacaacatatcccgtgaggagacaccacttaactatttcgatagttatcttggttgtgttgttaatgctgacaactcaactgaagaagctgttgacgcgtgtgatttgcgtatgggtagtgggctttgtgtcaactattcaacgtctcaccgcgctcgcagctctgtcagcacgggttataaattaactacttttgaaccatttacagtccgcattgtcaatgatagtgttgagtctgttgatgggttatatgagctgcaaataccaaccaactttactatagctagccatcaggagttcgttcaaacgaggtctccaaaggttactatagactgtgctgcatttgtctgtggtggccacacagcatgccgtcagcagttggttgagtacggctcattctgtgataatattaatgccattcttggcgaggtaaataacctcatagatactatgcaacttcaagttgcaagtgctttaatccaaggtgtcacgttaagctcacgcttatcggatggcattggtggtcaaatagatgatattaattttagtcctctgcttggttgtttaggttctgactgtggcgaagttaccatggcagctcaaaccggacgatctgctatagaggatgtattatttgacaaagtcaaactctctgatgttggctttgtcgaagcatataacaattgcactggaggccaagaagttagagacctactttgtgtgcaatcttttaatggcatcaaagtgctaccgcctgtgttgtctgagaatcaaatttctggttatacagcgggagctactgtatctgctatgttcccatggtctgcagctgcaggtgtgccattttctttaagtgttcaatatagaattaatggtcttggtgtcactatgaatgttcttagtgaaaatcagaaaatgatagcaagtgcatttaacaacgcgataggtgctatacaggaagggtttgctgcaaccaattctgccttagcaaaaatgcagttcgttgtcaatgcaaatgcggaagcactcaataatttattaaaccagctttccaataggtttggtgcaattagtgcttctttacaagaaattctatctcgcctagatgctcttgaagcgcaggctcagatagaccgtcttattaatggcagattaactgcacttaatgcatatgtctctaagcagctgagtgacatgacccttgttaaggtgagtgcagcccaggctatagagaaagttaatgagtgtgttaaaagccaatcatctaggataaatttctgtggcaatggcaatcatatattgtcattagtccagaatgcgccttatggtttatattttattcatttcagctatgtgcctacttcctttacaacggcaaatgtgagtcctgggctatgcatttctggtgatagaggattagcacctaaagctggatattttgttcaagatgatggagagtggaagttcacaggtagtaattattattaccctgaacccattacagataaaaatagtgtcgtgatgagtagttgcgcagcaaactacacaaaggcacctgaagttttcttgaacacttcaatacctaatctacccgactttaaggaggagttagataaatggtttaaaaatcagacgtctattgcgcctgatttatctctcgatttcgagaaattaaacgttaccctcctggacctgactgatgagatgaacaggattcaggatgcaattaagaagttaaatgagagttacatcaacctcaaggacgttggcacatatgaaatgtatgtgaaatggccttggtatgtgtggttgctaattggattagctggtgtagctgtttgtgtgttgttatttttcatatgttgctgcacgggttgtggctcatgttgtttcaagaagtgtggaaattgttgtgatgagtgtggaggacaccaggacagtattgtgatacataatatttcctctcatgaggattgactatcacagcctctcctggaaagacagaaaatctaaacaatttattgcactttccccgctacttggccccgtaagaggcagccatagctatggccgtgtagggtcctaaagctacattggctgctgtctttatcggtccatttattgtagcatgtatgctaggcattggcctagtttattcattgcaattgcaagtttaaatttttcatgttaatgataccatacgtgtgactggcaagccagccactgtgtcttatactataagtacaccagtaacgccgagtgccacgacgctcgacggtactacgtatactttaattagacccataagctcttatacaagagtttaccttggcaaaaccagagggtttgatactggtacatttggcccaaaggtcttggactatgttactaatctaaacctcatcttaattctggtcgtccatacaccttccgtaagcttggtttatgagaccgacagccacatggacatatggcatgtgagtgatgcttggttacgccgaacgcgagactttggtgtcactcgccttgaagatttttgctttcaatttaattattgccaacctcgaattggttattgtagagttcctttaaaggcttggtgtagcaaccagggtaaatttgcagcgcagtttacccttaaaagttgcgaaaaatcaggccaagaaatatttattactagcttcacggcctacgacaaaactgtcaaaaaggccgttagtaagctagtagaagaagctgttgattttatcatctggagagccacgcagctcgaaagatatgtttaatttattccttacagatacagtatggtatgtggggcagattatttttatagtcgcagtgtgtttgatggtcaccataatagtggttgccttccttgcgtctatcaaactttgtattcaactttgcggtttgtgtaatactttgttgctgtctccttctatttgtgtgtataataggagtaagcagctttataagtattataatgaagaagtgagaccgcccccgttagaggtggatgatataataatccaaacattatgactagtaccactcaggctccacagcctgtttatcagtggacggctgatgaggcaattcgattccttaaggaatggaatttctctctcggcattatactactttttgttactatcatactacagttcggttacacgagccgtagcatgtttgtttatgttgtgaaaatgatacttttgtggcttatgtggccactaactattgttttgtgtatttttaactgcgtctatgcgctaaataatgtgtatcttggattttctatagtgtttactatagtgtccattataatgtggattatgtattttgttaatagcatcaggttgtttatcaggactggcagctggtggagcttcaaccccgaaacaaacaacctaatgtgtatagatatgaaaggtactgtgtatgttagacccattatagaggattaccatacactaacagccactatcattcgtggtcacctctatatgcaaggtgttaagctaggcactggcttctctttgtctgatttgcctgcttatgttacagttgctaaggtgtctcacctttgcacttataagcgcgcattcttagacaaggtagacggtgttagcggttttgctgtttatgtgaagtccaaggtcggaaattaccgactgccctcaaataaaccgagtggcatggacaccgcattgttgagaatctaatctaaactttaaggatgtcttttgttcctgggcaagaaaatgccggtagcagaagctcctctggaaaccgcgctggtaatggcatcctcaagaagaccacttgggctgaccaaaccgagcgtggaaatagaggcagaaggaaccatcccaagcagactgcaactactcagcccaatgccgggagtgtggttccccattactcttggttttcgggcatcacccagtttcaaaagggaaaggagttccagtttgcacaaggacagggagtgcctattgccagtggaatccccgcttcagagcaaaagggatattggtatagacacaaccgacgttcttttaaaacacctgatggccagcacaagcagctactgcccagatggtatttttactatcttggaacagggccccatgctggcgcagagtatggcgacgatatcgaaggagttgtctgggtcgcaagccaacaggccgacactaagaccactgccgatgttgttgaaagggacccaagcagtcatgaggctattcctactaggtttgcgcccggcacggtattgcctcagggcttttatgtagaaggctcgggaaggtctgcacctgctagtcgatctggttcgcggtcacaatcccgtgggccaaataatcgcgctagaagcagttccaaccagcgccagcctgcctctgctgtaaaacctgacatggccgaagaaattgctgctcttgttttggctaagcttggtaaagatgccggccagcccaagcaggtaactaagcaaagcgccaaagaagtcaggcagaaaattttaactaagcctcgtcaaaagaggactccaaacaagcagtgcccagtgcagcagtgttttgggaagagaggccctaatcagaactttggaggctctgaaatgttaaaacttggaactagtgatccgcagttccccattcttgcagagttggctccaacacctagtgccttcttctttggatctaaattagaattggtcaaaaagaactctggtggtgctgatgaacccaccaaagatgtttatgaattgcagtattcaggtgcaattagatttgatagtactctacccggttttgagactatcatgaaagtgttgactgagaatttgaatgcctaccaggaccaagctggtagtgtagatctagtgagcccaaagcctccaagaagaggtcgtagacaggctcaagaaaagaaagatgaagtagataatgtaagcgttgcaaagcccaaaagcttggtgcagcgaaatgtaagtagagaattaacccccgaggatcgtagcctgctggctcagatcctagacgatggcgttgtgccagatgggttggaagatgactctaatgtgtaaagagaatgaatcctatgtcggcgctcggtggtaacccctcgcgagaaagtcgggataggacactctctatcagaatggatgtcttgctgtcataacagatagagaaggttgtggcagaccctgtatcaattagttgaaagagattgcaaaatagagaatgtgtgagagaagttagcaaggtcctacgtctaaccataagaacggcgataggcgccccctgggaagagctcacatcagggtactattcctgcaatgcactagtaaatgaatgaagttgatcatggccaattggaagaatcacaaaaaaaaaaaaaa

SEQ ID NO: 37 - DNA, 31357 bp, Coronavirus
tataagagtgattggcgtccgtacgtaccctctcaactctaaaactcttgtagtttaaatctaatctaaactttataaacggcacttcctgcgtgtccatgcccgcgggcctggtcttgtcatagtgctgacatttgtagttccttgactttcgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtaaccctgagaggtcagaggaggatgggttttgcccctctgctgcgcaagaaccgaaagttaaaggaaaaactttggttaatcacgtgagggtgaattgtagccggcttccagctttggaatgctgtgttcagtctgccataatccgtgatatttttgtagatgaggatccccagaaggtggaggcctcaactatgatggcattgcagttcggtagtgccgtcttggttaagccatccaagcgcttgtctattcaggcatggactaatttgggtgtgcttcccaaaacagctgccatggggttgttcaagcgcgtctgcctgtgtaacaccagggagtgctcttgtgacgcccacgtggcctttcacctttttacggtccaacccgatggtgtatgcctgggtaatggccgttttataggctggttcgttccagtcacagccataccggagtatgcgaagcagtggttgcaaccctggtccatccttcttcgtaagggtggtaacaaagggtctgtgacatccggccacttccgccgcgctgttaccatgcctgtgtatgactttaatgtagaggatgcttgtgaggaggttcatcttaacccgaagggtaagtactcctgcaaggcgtatgctcttcttaagggctatcgcggtgttaagcccatcctgtttgtggaccagtatggttgcgactatactggatgtctcgccaagggtcttgaggactatggcgatctcaccttgagtgagatgaaggagttgttccctgtgtggcgtgactccttggatagtgaagtccttgtggcttggcacgttgatcgagatcctcgggctgctatgcgtctgcagactcttgctactgtacgttgcattgattatgtgggccaaccgaccgaggatgtggtggatggagatgtggtagtgcgtgagcctgctcatcttctcgcagccaatgccattgttaaaagactcccccgtttggtggagactatgctgtatacggattcgtccgttacagaattctgttataaaaccaagctgtgtgaatgcggttttatcacgcagtttggctatgtggattgttgtggtgacacctgcgattttcgtgggtgggttgccggcaatatgatggatggctttccatgtccagggtgtaccaaaaattatatgccctgggaattggaggcccagtcatcaggtgttataccagaaggaggtgttctattcactcagagcactgatacagtgaatcgtgagtcctttaagctctacggtcatgctgttgtgccttttggttctgctgtgtattggagcccttgcccaggtatgtggcttccagtaatttggtcttctgttaagtcatactctggtttgacttatacaggagtagttggttgtaaggcaattgttcaagagacagacgctatatgtcgttctctgtatatggattatgtccagcacaagtgtggcaatctcgagcagagagctatccttggattggacgatgtctatcatagacagttgcttgtgaataggggtgactatagtctcctccttgagaatgtggatttgtttgttaagcggcgcgctgaatttgcttgcaaattcgccacctgtggagatggtcttgtacccctcctactagatggtttagtgccccgcagttattatttgattaagagtggtcaagctttcacctctatgatggttaattttagccatgaggtgactgacatgtgtatggacatggctttattgttcatgcatgatgttaaagtggccactaagtatgttaagaaggttactggcaaactggccgtgcgctttaaagcgttgggtgtagccgttgtcagaaaaattactgaatggtttgatttagccgtggacattgctgctagtgccgctggatggctttgctaccagctggtaaatggcttatttgcagtggccaatggtgttataacctttgtacaggaggtgcctgagcttgtcaagaattttgttgacaagttcaaggcatttttcaaggttttgatcgactctatgtcggtttctatcttgtctggacttactgttgtcaagactgcctcaaatagggtgtgtcttgctggcagtaaggtttatgaagttgtgcagaaatctttgtctgcatatgttatgcctgtgggttgcagtgaagccacttgtttggtgggtgagattgaacctgcagtttttgaagatgatgttgttgatgtggttaaagccccattaacatatcaaggctgttgtaagccacccacttctttcgagaagatttgtattgtggataaattgtatatggccaagtgtggtgatcaattttaccctgtggttgttgataacgacactgttggcgtgttagatcagtgctggaggtttccctgtgcgggcaagaaagtcgagtttaacgacaagcccaaagtcaggaagataccctccacccgtaagattaagatcaccttcgcactggatgcgacctttgatagtgttctttcgaaggcgtgttcagagtttgaagttgataaagatgttacattggatgagctgcttgatgttgtgcttgacgcagttgagagtacgctcagcccttgtaaggagcatgatgtgataggcacaaaagtttgtgctttacttgataggttggcaggagattatgtctatctttttgatgagggaggcgatgaagtgatcgccccgaggatgtattgttccttttctgctcctgatgatgaagactgcgttgcagcggatgttgtagatgcagatgaaaaccaagatgatgatgctgaagactcagcagtccttgtcgctgatacccaagaagaggacggcgttgccaaggggcaggttgaggcggattcggaaatttgcgttgcgcatactggtagtcaagaagaattggctgagcctgatgctgtcggatctcaaactcccatcgcctctgctgaggaaaccgaagtcggagaggcaagcgacagggaagggattgctgaggcgaaggcaactgtgtgtgctgatgctgtagatgcctgccccgatcaagtggaggcatttgaaattgaaaaggttgaagactctatcttggatgagcttcaaactgaacttaatgcgccagcggacaagacctatgaggatgtcttggcattcgatgccgtatgctcagaggcgttgtctgcattctatgctgtgccgagtgatgagacgcactttaaagtgtgtggattctattcgcctgctatagagcgcactaattgttggctgcgttctactttgatagtaatgcagagtctacctttggaatttaaagacttggagatgcaaaagctctggttgtcttacaaggccggctatgaccaatgctttgtggacaaactagttaagagcgtgcccaagtctattatccttccacaaggtggttatgtggcagattttgcctatttctttctaagccagtgtagctttaaagcttatgctaactggcgttgtttagagtgtgacatggagttaaagcttcaaggcttggacgccatgtttttctatggggacgttgtgtctcatatgtgcaagtgtggtaatagcatgaccttgttgtctgcagatataccctacactttgcattttggagtgcgagatgataagttttgcgctttttacacgccaagaaaggtctttagggctgcttgtgcggtagatgttaatgattgtcactctatggctgtagtagagggcaagcaaattgatggtaaagtggttaccaaatttattggtgacaaatttgattttatggtgggttacgggatgacatttagtatgtctccttttgaactcgcccagttatatggttcatgtataacaccaaatgtttgttttgttaaaggagatgttataaaggttgttcgcttagttaatgctgaagtcattgttaaccctgctaatgggcgtatggctcatggtgcaggtgttgcaggtgctatagctgaaaaggcgggcagtgcttttattaaagaaacctccgatatggtgaaggctcagggcgtttgccaggttggtgaatgctatgaatctgccggtggtaagttatgtaaaaaggtgcttaacattgtagggccagatgcgcgagggcatggcaagcaatgctattcacttttagagcgtgcttatcagcatattaataagtgtgacaatgttgtcactactttaatttcggctggtatatttagtgtgcctactgatgtctccctaacttacttacttggtgtagtgacaaagaatgtcattcttgtcagtaacaaccaggatgattttgatgtgatagagaagtgtcaggtgacctccgttgctggtaccaaagcgctatcacttcaattggccaaaaatttgtgccgtgatgtaaagtttgtgacgaatgcatgtagttcgctttttagtgaatcttgctttgtctcaagctatgatgtgttgcaggaagttgaagcgctgcgacatgatatacaattggatgatgatgctcgtgtctttgtgcaggctaatatggactgtctgcccacagactggcgtctcgttaacaaatttgatagtgttgatggtgttagaaccattaagtattttgaatgcccgggcgggatttttgtatccagccagggcaaaaagtttggttatgttcagaatggttcatttaaggaggcgagtgttagccaaataagggctttactcgctaataaggttgatgtcttgtgtactgttgatggtgttaacttccgctcctgctgcgtagcagagggtgaagtttttggcaagacattaggttcagtcttttgtgatggcataaatgtcaccaaagttaggtgtagtgccatttacaagggtaaggttttctttcagtacagtgatttgtccgaggcagatcttgtggctgttaaagatgcctttggttttgatgaaccacaactgctgaagtactacactatgcttggcatgtgtaagtggtcagtagttgtttgtggcaattattttgctttcaagcagtcaaataataattgctatataaatgtggcatgtttaatgctgcaacacttgagtttaaagtttcctaagtggcaatggcaagaggcttggaacgagttccgctctggtaaaccactaaggtttgtgtccttggtattagcaaagggcagctttaaatttaatgaaccttctgattctatcgattttatgcgtgtggtgctacgtgaagcagatttgagtggtgccacgtgcaatttggaatttgtttgtaaatgtggtgtgaagcaagagcagcgcaaaggtgttgacgctgttatgcattttggtacgttggataaaggtgatcttgtcaggggttataatatcgcatgtacgtgcggtagtaaacttgtgcattgcacccaatttaacgtaccatttttaatttgctccaacacaccagagggtaggaaactgcccgacgatgttgttgcagctaatatttttactggtggtagtgtgggccattacacgcatgtgaaatgtaaacccaagtaccagctttatgatgcttgtaatgttaataaggtttcggaggctaagggtaattttaccgattgcctctaccttaaaaatttaaagcaaactttttcgtctgtgctgacgactttttatttagatgatgtaaagtgtgtggagtataagccagatttatcgcagtattactgtgagtctggtaaatattatacaaaacccattattaaggcccaatttagaacatttgagaaggttgatggtgtctataccaactttaaattggtgggacatagtattgctgaaaaactcaatgctaagctgggatttgattgtaattctccctttgtggagtataaaattacagagtggccaacagctactggagatgtggtgttggctagtgatgatttgtatgtaagtcggtactcaagcgggtgcattacttttggtaaaccggttgtctggcttggccatgaggaagcatcgctgaaatctctcacatattttaatagacctagtgtcgtttgtgaaaataaatttaatgtgttgcccgttgatgtcagtgaacccacggacaaggggcctgtgcctgctgcagtccttgttaccggcgtccctggagctgatgcgtcagctggtgccggtattgccaaggagcaaaaagcctgtgcttctgctagtgtggaggatcaggttgttacggaggttcgtcaagagccatctgtttcagctgctgatgtcaaagaggttaaattgaatggtgttaaaaagcctgttaaggtggaaggtagtgtggttgttaatgatcccactagcgaaaccaaagttgttaaaagtttgtctattgttgatgtctatgatatgttcctgacagggtgtaagtatgtggtttggactgctaatgagttgtctcgactagtaaattcaccgactgttagggagtatgtgaagtggggtaagggaaagattgtaacacccgctaagttgttgttgttaagagatgagaagcaagagttcgtagcgccaaaagtagtcaaggcgaaagctattgcctgctattgtgctgtgaagtggtttctcctctattgttttagttggataaagtttaatactgataataaggttatatacaccacagaagtagcttcaaagcttactttcaagttgtgctgtttggcctttaagaatgccttacagacgtttaattggagcgttgtgtctaggggctttttcctagttgcaacggtctttttattatggtttaactttttgtatgctaatgttattttgagtgacttctatttgcctaatattgggcctctccctacgtttgtgggacagatagttgcgtggtttaagactacatttggtgtgtcaaccatctgtgatttctaccaggtgacggatttgggctatagaagttcgttttgtaatggaagtatggtatgtgaactatgcttctcaggttttgatatgctggacaactatgatgctataaatgttgttcaacacgttgtagataggcgtttgtcctttgactatattagcctatttaaattagtagttgagcttgtaatcggctactctctttatactgtgtgcttctacccactgtttgtccttattggaatgcagttgttgaccacatggttgcctgaattctttatgctggagactatgcattggagtgctcgtttgtttgtgtttgttgccaatatgcttccagcttttacgttactgcgattttacatcgtggtgacagctatgtataaggtctattgtctttgtagacatgttatgtatggatgtagtaagcctggttgcttgttttgttataagagaaaccgtagtgtccgtgttaagtgtagcaccgttgttggtggttcactacgctattacgatgtaatggctaacggcggcacaggtttctgtacaaagcaccagtggaactgtcttaattgcaattcctggaaaccaggcaatacattcataactcatgaagcagcggcggacctctctaaggagttgaaacgccctgtgaatccaacagattctgcttattactcggtcacagaggttaagcaggttggttgttccatgcgtttgttctacgagagagatggacagcgtgtttatgatgatgttaatgctagtttgtttgtggacatgaatggtctgctgcattctaaagttaaaggtgtgcctgaaacgcatgttgtggttgttgagaatgaagctgataaagctggttttctcggcgccgcagtgttttatgcacaatcgctctacagacctatgttgatggtggaaaagaaattaataactaccgccaacactggtttgtctgttagtcgaactatgtttgacctttatgtagattcattgctgaacgtcctcgacgtggatcgcaagagtctaacaagttttgtaaatgctgcgcacaactctctaaaggagggtgttcagcttgaacaagttatggatacctttattggctgtgcccgacgtaagtgtgctatagattctgatgttgaaaccaagtctattaccaagtccgtcatgtcggcagtaaatgctggcgttgattttacggatgagagttgtaataacttggtgcctacctatgttaaaagtgacactatcgttgcagccgatttgggtgttcttattcagaataatgctaagcatgtacaggctaatgttgctaaagccgctaatgtggcttgcatttggtctgtggatgcttttaaccagctatctgctgacttacagcataggctgcgaaaagcatgttcaaaaactggcttgaagattaagcttacttataataagcaggaggcaaatgttcctattttaactacaccgttctctcttaaagggggcgctgtttttagtagaatgttacaatggttgtttgttgctaatttgatttgtttcattgtgttgtgggcccttatgccaacatatgcagtgcacaaatcggatatgcagttgcctttatatgccagttttaaagttatagataatggtgtgctaagggatgtgtctgttactgacgcatgcttcgcaaacaaatttaatcaatttgatcaatggtatgagtctacttttggtcttgcttattaccgcaactctaaggcttgtcctgttgtggttgctgtaatagatcaagacattggccataccttatttaatgttcctaccacagttttaagatatggatttcatgtgttgcattttataacccatgcatttgctactgatagcgtgcagtgttacacgccacatatgcaaatcccctatgataatttctatgctagtggttgcgtgttgtcatccctctgtactatgcttgcgcatgcagatggaaccccgcatccttattgttatacagggggtgttatgcacaatgcctctctgtatagttctttggctcctcatgtccgttataacctggctagttcaaatggttatatacgttttcccgaagtggttagtgaaggcattgtgcgtgttgtgcgcactcgctctatgacctactgcagggttggtttatgtgaggaggccgaggagggtatctgctttaattttaatcgttcatgggtattgaacaacccgtattatagggccatgcctggaactttttgtggtaggaatgcttttgatttaatacatcaagttttaggaggattagtgcggcctattgatttctttgccttaacggcgagttcagtggctggtgctatccttgcaattattgtcgttttggctttctattatttaataaagcttaaacgtgcctttggtgactacactagtgttgtggttatcaatgtaattgtgtggtgtataaattttctgatgctttttgtgtttcaggtttatcccacattgtcttgtttatatgcttgtttttatttctacacaacgctttatttcccttcggagataagtgttgttatgcatttgcaatggcttgtcatgtatggtgctattatgcccttgtggttttgcattatttacgtggcagtcgttgtttcaaaccatgcattgtggttgttctcttactgccgcaaaattggtaccgaggttcgtagtgacggcacatttgaggaaatggcccttactacctttatgattactaaagaatcttattgtaagttgaaaaattctgtttctgatgttgcttttaacaggtacttgagtctttataacaagtatcgttattttagtggcaaaatggatactgccgcttatagagaggctgcctgttcacaactggcaaaggcaatggaaacatttaaccataataatggtaatgatgttctctatcagcctccaaccgcctctgttactacatcatttttacagtctggtatagtgaagatggtgtcgcccacctctaaagtggagccttgtattgttagtgttacttatggtaacatgacacttaatgggttgtggttggatgataaagtttattgcccaagacatgttatctgttcttcagctgacatgacagaccctgattatcctaatttgctttgtagagtgacatcaagtgatttttgtgttatgtctggtcgtatgagccttactgtaatgtcttatcaaatgcagggctgccaacttgttttgactgttacactgcaaaatcctaacacgcctaagtattccttcggtgttgttaagcctggtgagacatttactgtactggctgcatacaatggcagacctcaaggagccttccatgttacgcttcgtagtagccataccataaagggctcctttctatgtggatcctgcggttctgtaggatatgttttaactggcgatagtgtacgatttgtttatatgcatcagctagagttgagtactggttgtcataccggtactgactttagtgggaacttttatggtccctatagagatgcgcaagttgtacaattgcctgttcaggattatacgcagactgttaatgttgtagcttggctttatgctgctatttttaacagatgcaactggtttgtgcaaagtgatagttgttccctggaggagtttaatgtttgggctatgaccaatggttttagctcaatcaaagccgatcttgtcttggatgcgcttgcttctatgacaggcgttacagttgaacaggtgttggccgctattaagaggctgcattctggattccagggcaaacaaattttaggtagttgtgtgcttgaagatgagctgacaccaagtgatgtttatcaacaactagctggtgtcaagctacagtcaaagcgcacaagagttataaaaggtacatgttgctggatattggcttcaacgtttttgttctgtagcattatctcagcatttgtaaaatggactatgtttatgtatgttactacccatatgttgggagtgacattgtgtgcactttgttttgtaagctttgctatgttgttgatcaagcataagcatttgtatttaactatgtatattatgcctgtgttatgcacactgttttacaccaactatttggttgtgtacaaacagagttttagaggtctagcttatgcttggctttcacactttgtccctgctgtagattatacatatatggatgaagttttatatggtgttgtgttgctagtagctatggtgtttgttaccatgcgtagcataaaccacgacgtcttttctattatgttcttggttggtagacttgtcagcctggtatccatgtggtattttggagccaatttagaggaagaggtactattgttcctcacatccctatttggcacgtacacatggactactatgttgtcattggctaccgctaaggttattgctaaatggttggctgtgaatgtcttgtacttcacagacgtaccgcaaattaaattagttcttttgagctacttgtgtattggttatgtgtgttgttgttattggggaatcttgtcactccttaatagcatttttaggatgccattgggcgtctacaattataaaatctccgttcaggagttacgttatatgaatgctaatggcttgcgcccacctagaaatagttttgaggccctgatgcttaattttaagctgttgggaattggtggtgtgccagtcattgaagtatctcaaattcaatcaagattgacggatgttaaatgtgctaatgttgtgttgcttaattgcctccagcacttgcatattgcatctaattctaagttgtggcagtattgtagtactttgcacaatgaaatactggctacatctgatttgagcgtggccttcgataagttggctcagctcttagttgttttatttgctaatccagcagcagtggatagcaagtgccttgcaagtattgaagaagtgagcgatgattacgttcgcgacaatactgtcttgcaagccttacagagtgaatttgttaatatggctagcttcgttgagtatgaacttgctaagaagaatctagatgaggctaaggctagcggctctgccaatcaacagcagattaagcagctagagaaggcgtgtaatattgctaagtcagcatatgagcgcgacagagctgttgctcgtaagctggaacgtatggctgatttagctcttacaaacatgtataaagaagctagaattaatgataagaagagtaaggtagtgtctgcattgcaaaccatgctctttagtatggtgcgtaagctagataaccaagctcttaattctattttagataatgcagttaagggttgtgtacctttgaatgcaataccatcattgacttcgaacactctgactataatagtgccagataagcaggtttttgatcaggttgtggataatgtgtatgtcacctatgctgggaatgtatggcatatacagtttattcaagatgctgatggtgctgttaaacaattgaatgagatagatgttaattcaacctggcctctagtcattgctgcaaataggcataatgaagtgtctactgttgttttgcagaacaatgagttgatgcctcagaagttgagaactcaggttgtcaatagtggctcagatatgaattgtaatactcctacccagtgttactataatactactggcacgggtaagattgtgtatgctatacttagtgactgtgatggtctcaagtacactaagatagtaaaagaagatggaaattgtgttgttttggaattggatcctccctgtaagttttctgttcaggatgtgaagggccttaaaattaagtacctttactttgtgaaggggtgtaatacactggctagaggctgggttgtaggcaccttatcctcgacagtgagattgcaggcgggtacggcaactgagtatgcctccaactctgcaatactgtcgctgtgtgcgttttctgtagatcctaagaaaacgtacttggattatataaaacagggtggagttcccgttactaattgtgttaagatgttatgtgaccatgctggcactggtatggccattactattaagccggaggcaaccactaatcaggattcttatggtggtgcttccgtttgtatatattgccgctcgcgtgttgaacatccagatgttgatggattgtgcaaattacgcggcaagtttgtccaagtgcccttaggcataaaagatcctgtgtcatatgtgttgacgcatgatgtttgtcaggtttgtggcttttggcgagatggtagctgttcctgtgtaggcacaggctcccagtttcagtcaaaagacacgaactttttaaacgggttcggggtacaagtgtaaatgcccgtcttgtaccctgtgccagtggcttggacactgatgttcaattaagggcatttgacatttgtaatgctaatcgagctggcattggtttgtattataaagtgaattgctgccgcttccagcgtgtagatgaggacggcaacaagttggataagttctttgttgttaaaagaactaatttagaagtgtataataaggagaaagaatgctatgagttgacaaaagaatgcggtgttgtggctgaacacgagttcttcacatttgatgtggagggaagtcgggtaccacacatagtccgtaaagatctttcaaagtttactatgttagatctttgctatgcattgcgtcattttgaccgcaatgattgttcaactcttaaggaaattctccttacatatgctgagtgtgaagagtcctacttccaaaagaaggactggtatgattttgttgagaatcctgatataattaatgtgtataaaaagcttggtcctatatttaatagagccctgcttaacactgccaagtttgcagacgcattagtggaggcaggcttagtaggtgttttaacacttgataatcaagatttatatggtcaatggtatgactttggagattttgtcaagacagtacctggttgtggtgttgccgtggcagactcttattattcatatatgatgccaatgctgactatgtgtcatgcgttggatagtgagttgtttgttaatggtacttatagggagtttgaccttgttcagtatgattttactgatttcaagctagagctcttcactaagtattttaagcattggagtatgacctaccacccgaacacctgtgagtgcgaggatgacaggtgcattattcattgcgccaattttaatatactttttagtatggtcttacctaagacctgttttgggcctcttgttaggcagatatttgtggatggtgttcctttcgttgtgtcgatcggttaccattataaagaattaggtgttgttatgaatatggatgtggatacacatcgttatcgcttgtctcttaaggacttgcttttgtatgctgcagaccctgcccttcatgtggcgtctgctagtgcactgcttgatttgcgcacatgttgttttagcgttgcagctattacaagtggcgtaaaatttcaaacagttaaacctggaaattttaatcaggatttttatgagtttattttgagtaaaggcctgcttaaagaggggagctccgttgatttgaagcacttcttctttacgcaggatggtaatgctgctattactgattataattattacaagtataatctacccaccatggtggatattaagcagttgttgtttgttttagaagttgttaataagtattttgagatctatgagggtgggtgtatacccgcaacacaggtcattgttaataattatgataagagtgctggctatccatttaataaatttggaaaggccaggctctattatgaggcattatcatttgaggagcaggatgaaatttatgcgtataccaaacgcaatgtcctgccgaccctaactcaaatgaatcttaaatatgctattagtgctaagaatagggcccgcaccgttgctggtgtctctattctcagtactatgactggcagaatgtttcatcaaaagtgtctaaagagtatagcagctactcgcggtgttcctgtagttataggcaccacgaagttctatggcggttgggatgatatgttacgccgccttattaaagatgttgatagtcctgtactcatgggttgggactatcctaaatgtgatcgtgctatgccaaacatactgcgtattgttagtagtttggtgctagcccgtaaacatgattcgtgctgttcgcatacggatagattctatcgtcttgcgaacgagtgcgcccaagttttgagtgaaattgttatgtgtggtggttgttattatgttaaaccaggtggcactagtagtggggatgcaaccactgcttttgctaattctgtgtttaacatttgtcaagctgtttccgccaatgtatgctcgcttatggcatgcaatggacacaaaattgaagatttgagtatacgcgagttacaaaagcgcctatactctaatgtctatcgtgcggaccatgttgaccccgcatttgttagtgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggccaaatgttgggtagaaacagacatcgaaaagggaccgcatgaattttgttctcaacatacaatgctagtcaagatggatggtgatgaagtctaccttccataccctgatccttcgagaatcttaggagcaggctgttttgttgatgatttattaaagactgatagcgttctcttgatagagcgtttcgtaagtcttgcaattgatgcttatcctttagtataccatgagaacccagagtatcaaaatgtgttccgggtatatttagaatatataaagaagctgtacaatgatctcggtaatcagatcctggacagctacagtgttattttaagtacttgtgatggtcaaaagtttactgatgagaccttttacaagaacatgtatttaagaagtgcagtgctgcaaagcgttggtgcctgcgttgtctgtagttctcaaacatcattacgttgtggcagttgcatacgcaagcctttgctgtgttgcaaatgcgcctatgatcatgttatgtccactgatcataaatatgtcctgagtgtgtcaccatatgtgtgtaattcaccgggatgtgatgtaaatgatgttaccaaattgtatttaggtggtatgtcatattattgtgaggaccataaaccacagtattcattcaaattggtgatgaatggtatggtttttggtttatataaacaatcttgtactggttcgccctacatagaggattttaataaaatagctagttgcaaatggacagaagtcgatgattatgtgctagctaatgaatgcaccgaacgccttaaattgtttgccgcagaaacgcagaaggccacagaagaggcctttaagcaatgttatgcgtcagcaacgatccgtgagatcgtgagcgatcgggagttaattttatcttgggaaattggtaaagtgagaccaccacttaataaaaattatgtttttactggctaccattttactaataatggtaagacagttttaggtgagtatgtttttgataagagtgagttgactaatggtgtgtactatcgcgccacaaccacttataagttatctgtaggtgatgtgttcattttaacatcacacgcagtgtctagtttaagtgctcctacattagtaccgcaggagaattatactagcattcgttttgctagtgtttatagtgtgcctgagacgtttcagaataatgtgcctaattatcagcacattggaatgaagcgctattgtactgtacagggaccgcctggtactggtaagtcccatctagccattgggctagctgtttattattgtacagcgcgcgtggtgtataccgctgctagccatgctgcagttgacgcgctgtgtgaaaaggcacataaatttttaaatattaatgactgcacgcgtattgttcctgcaaaggtgcgtgtagattgttatgataaatttaaggtcaatgacaccactcgcaagtatgtgtttactacaataaatgcattacctgagttggtgactgacattattgtcgttgatgaagttagtatgcttaccaactatgagctgtctgttattaacagtcgtgttagtgctaagcattatgtgtatattggagaccctgcgcagttacctgcaccacgtgtgctactgaataagggaactctagaacctagatattttaattccgttaccaagctaatgtgttgtttgggtccagatattttcttgggcacctgttatagatgccctaaggagattgtggatacggtgtcagccttggtttataataataagctgaaggctaaaaatgataatagctccatgtgctttaaggtttattataagggccagactacacatgagagttctagtgctgttaatatgcagcaaatacatttaattagtaagtttttaaaggcaaaccccagttggagtaacgccgtatttattagtccttataatagtcagaactatgttgctaagagagtcttgggattacaaacccagacagtagactcagcgcagggttctgaatatgattttgttatttattcacagactgcggaaacagcgcattctgtcaatgtaaatagattcaatgttgctattacacgtgctaagaagggtattctctgtgtcatgagtagtatgcaattatttgagtctcttaattttactacactgacgttggataagattaacaatccacgattacagtgtactacaaatttgtttaaggattgtagcaggagctatgtaggatatcacccagcccatgcaccatcctttttggcagttgatgacaaatataaggtaggcggtgatttagccgtttgccttaatgttgctgattctgctgtcacttattcgcggcttatatcactcatgggattcaagcttgacttgacccttgatggttattgtaagctgtttataactagagatgaagctatcaaacgtgttagagcctgggttggcttcgatgcagaaggtgcccatgcgatacgtgatagcattgggacaaatttcccattacaattaggcttttcgactggaattgattttgttgtcgaagccactggaatgtttgctgagagagatggttatgtctttaaaaaggcagccgcacgagctcctcctggcgaacaatttaaacaccttatcccacttatgtcaagagggcagaaatgggatgtggttcgaattagaatagtacaaatgttgtcagaccacctagcggatttggcagacagtgttgtacttgtgacgtgggctgccagctttgagctcacatgtttgcgatatttcgctaaagttggaagagaagttgtgtgtagtgtctgcaccaagcgtgcgacatgttttaattctagaactggatactatggatgctggcgacatagttattcctgtgattacctgtacaacccactaatagttgacattcaacagtggggatatacaggatctttaactagcaatcatgatcctatttgcagcgtgcataagggtgctcatgttgcatcatctgatgctatcatgacccggtgtctagctgttcatgattgcttttgtaagtctgttaattggaatttagaataccccattatttcaaatgaggtcagtgttaatacctcctgcaggttattgcagcgcgtaatgtttagggctgcgatgctatgcaataggtatgatgtgtgttatgacattggcaaccctaaaggtcttgcctgtgtcaaaggatatgattttaagttttatgatgcctcccctgttgttaagtctgttaaacagtttgtttataaatacgaggcacataaagatcaatttttagatggtttgtgtatgttttggaactgcaatgtggataagtatccagcgaatgcagttgtgtgtaggtttgacacgcgtgtgttgaacaaattaaatctccctggctgtaatggtggcagtttgtatgttaacaaacatgcattccacaccagtccctttacccgggctgccttcgagaatttgaagcctatgcctttcttttattattcagatacgccctgtgtgtatatggaaggcatggaatctaagcaggtcgattatgtcccattgagaagcgctacatgcatcacaagatgcaatttaggtggcgctgtttgtttaaaacatgctgaggagtatcgtgagtaccttgagtcttacaatacggcaaccacagcgggttttactttttgggtctataagacttttgatttttataacctttggaatacttttactaggctccaaagtttagaaaatgtagtgtataatttggtcaatgctggacactttgatggccgggcgggtgaactgccttgtgctgttataggtgagaaagtcattgccaagattcaaaatgaggatgtcgtggtctttaaaaataacacgccattccccactaatgtggctgtcgaattatttgctaagcgcagtattcggccccaccccgagcttaagctctttagaaatttgaatattgacgtgtgctggagtcacgtcctttgggattatgctaaggatagtgtgttttgcagttcgacgtataaggtctgcaaatacacagatttacagtgcattgaaagcttgaatgtactttttgatggtcgtgataatggtgctcttgaagcttttaagaagtgccggaatggcgtctacattaacacgacaaaaattaaaagtctgtcgatgattaaaggcccacaacgtgccgatttgaatggcgtagttgtggagaaagttggagattctgatgtggaattttggtttgctgtgcgtaaagacggtgacgatgttatcttcagccgtacagggagccttgaaccgagccattaccggagcccacaaggtaatccgggtggtaatcgcgtgggtgatctcagcggtaatgaagctctagcgcgtggcactatctttactcaaagcagattattatcttctttcacacctcgatcagagatggagaaagattttatggatttagatgatgatgtgttcattgcaaaatatagtttacaggactacgcgtttgaacacgttgtttatggtagttttaaccagaagattattggaggtttgcatttgcttattggcttagcccgtaggcagcaaaaatccaatctggtaattcaagagttcgtgacatacgactctagcattcattcgtactttatcactgacgagaacagtggtagtagtaagagtgtgtgcactgttattgatttattgttagatgattttgtggacattgtaaagtccctgaatctaaagtgtgtgagtaaggttgttaatgttaatgttgattttaaagatttccagtttatgttgtggtgcaatgaggagaaggtcatgactttctatcctcgtttgcaggctgctgctgactggaaacctggttatgttatgcctgtcttatataagtatttggaatcgcctctggaaagagtaaacctctggaattatggcaagccgattactttacctacaggatgtatgatgaatgttgctaagtatactcaattatgtcaatatttgagcactacaacattagcagttccggctaatatgcgtgtcttacaccttggtgccggttcggataagggtgttgcccctgggtctgcagttcttaggcagtggctaccagcgggaagtattcttgtagataatgatgtgaatccatttgtgagtgacagtgtcgcctcatattatggaaattgtataaccttaccctttgattgtcagtgggatctgataatttctgatatgtacgaccctcttactaagaacattggggagtacaacgtgagtaaagatggattctttacttacctctgtcatttaattcgtgacaagttggctctgggtggcagtgttgccataaaaataacagagttttcttggaacgctgagttatatagtttaatggggaagtttgcgttctggacaatcttttgcaccaacgtaaacgcctcttcaagtgaaggatttttgattggcataaattggttgaataagacccgtaccgaaattgacggtaaaaccatgcatgccaattatctgttttggagaaatagtacaatgtggaatggaggggcttacagtctctttgacatgagtaagttccctttgaaagcggctggtacggctgttgttagccttaaaccagaccaaataaatgacttagtcctctccttgattgagaagggcaagttattagtgcgtgatacacgcaaagaagtttttgttggcgatagcctagtaaatgtcaaataaatctatacttgtcgtggctgtgaaaatggcctttgctgacaagcctaatcatttcataaactttcccctggcccaatttagtggctttatgggtaagtatttaaagctacagtctcaacttgtggaaatgggtttagactgtaaattacagaaggcaccacatgttagtattaccctgcttgatattaaagcagaccaatacaaacaggtggaatttgcaatacaagaaataatagatgatctggcggcatatgagggagatattgtctttgacaaccctcacatgcttggcagatgccttgttcttgatgttagaggatttgaagagttgcatgaagatattgttgaaattctccgcagaaggggttgcacggcagatcaatccagacactggattccgcactgcactgtggcccaatttgacgaagaaagagaaacaaaaggaatgcaattctatcataaagaacccttctacctcaagcataacaacctattaacggatgctgggcttgagctcgtgaagataggttcttccaaaatagatgggttttattgtagtgaactgagtgtttggtgtggtgagaggctttgttataagcctccaacacccaaattcagtgatatatttggctattgctgcatagataaaatacgtggtgatttagaaataggagacctaccgcaggatgatgaggaagcgtgggccgagctaagttaccactatcaaagaaacacctacttcttcagacatgtgcacgataatagcatctattttcgtaccgtgtgtagaatgaagggttgtatgtgttgatttgtttttacactattagtgtaataagcttattattttgttgaaaagggcaggatgtgcatagctatggctcctcgcacactgcttttgctgatttgatgtcagctggtgtttgggttcaatgaacctcttaacatcgtttcacatttaaatgatgactggtttctatttggtgacagtcgttctgactgtacctatgtagaaaataacggtcatcctaaattagattggcttgacctcgacccaaagttgtgtaattcaggaaagatttccgcaaagagtggtaactctctctttaggagttttcacttcactgatttttacaattatacgggtgagggagaccaaattgtattttatgaaggagttaattttagtcccagccatggctttaaatgcctggctcatggagataataaaagatggatgggcaataaagctcgattttatgcccgagtgtatgagaagatggcccaatataggagcctatcgtttgttaatgtgtcttatgcctatggaggtaatgcaaagcccgcctccatttgcaaagacaatactttaacactcaataaccccaccttcatatcgaaggagtctaattatgttgattattactatgagagtgaggctaatttcacactagaaggttgtgatgaatttatagtaccgctctgtggttttaatggccattccaagggcagctcttcggatgctgccaataaatattatactgactctcagagttactataatatggatattggtgtcttatatgggttcaattcgaccttggatgttggcaacactgctaaggatccgggtcttgatctcacttgcaggtatcttgcattgactcctggtaattataaggctgtgtccttagaatatttgttaagcttaccctcaaaggctatttgcctccataagacaaagcgctttatgcctgtgcaggtagttgactcaaggtggagtagcatccgccagtcagacaatatgaccgctgcagcctgtcagctgccatattgtttctttcgcaacacatctgcgaattatagtggtggcacacatgatgcgcaccatggtgattttcatttcaggcagttattgtctggtttgttatataatgtttcctgtattgcccagcagggtgcatttctttataataatgttagttcctcttggccagcctatgggtacggtcattgtccaacggcagctaacattggttatatggcacctgtttgtatctatgaccctctcccggtcatactgctaggtgtgttattgggtatagctgtgttgattattgtgtttttgatgttttattttatgacggatagcggtgttagattgcatgaggcataatctaaacatgctgttcgtgtttattctatttttgccctcttgtttagggtatattggtgattttagatgtatccagcttgtgaattcaaacggtgctaatgttagtgctccaagcattagcactgagaccgttgaagtttcacaaggcctggggacatattatgtgttagatcgagtttatttaaatgccacattattgcttactggttactacccggtcgatggttctaagtttagaaacctcgctcttacgggaactaactcagttagcttgtcgtggtttcaaccaccctatttaagtcagtttaatgatggcatatttgcgaaggtgcagaaccttaagacaagtacgccatcaggtgcaactgcatattttcctactatagttataggtagtttgtttggctatacttcctataccgttgtaatagagccatataatggtgttataatggcctcagtgtgccagtataccatttgtctgttaccttacactgattgtaagcctaacactaatggtaataagcttatagggttttggcacacggatgtaaaacccccaatttgtgtgttaaagcgaaatttcacgcttaatgttaatgctgatgcattttattttcatttttaccaacatggtggtactttttatgcgtactatgcggataaaccctccgctactacgtttttgtttagtgtatatattggcgatattttaacacagtattatgtgttacctttcatctgcaacccaacagctggtagcacttttgctccgcgctattgggttacacctttggttaagcgccaatatttgtttaatttcaaccagaagggtgtcattactagtgctgttgattgtgctagtagttataccagtgaaataaaatgtaagacccagagcatgttacctagcactggtgtctatgagttatccggttatacggtccaaccagttggagttgtataccggcgtgttgctaacctcccagcttgtaatatagaggagtggcttactgctaggtcagtcccctcccctctcaactgggagcgtaagacttttcagaattgtaattttaatttaagcagcctgttacgttatgttcaggctgagagtttgttttgtaataatatcgatgcttccaaagtgtatggcaggtgctttggtagtatttcagttgataagtttgctgtaccccgaagtaggcaagttgatttacagcttggtaactctggatttctgcagactgctaattataagattgatacagctgccacttcgtgtcagctgcattacaccttgcctaagaataatgtcaccataaacaaccataacccctcgtcttggaataggaggtatggctttaatgatgctggcgtctttggcaaaaaccaacatgacgttgtttacgctcagcaatgttttactgtaagatctagttattgcccgtgtgctcaaccggacatagttagcccttgcactactcagactaagcctaagtctgcttttgttaatgtgggtgaccattgtgaaggcttaggtgttttagaagataattgtggcaatgctgatccacataagggttgtatctgtgccaacaattcatttattggatggtcacatgatacctgccttgttaatgatcgctgccaaatttttgctaatatattgttaaatggcattaatagtggtaccacatgttccacagatttgcagttgcctaatactgaagtggttactggcatttgtgtcaaatatgacctctacggtattactggacaaggtgtttttaaagaggttaaggctgactattataatagctggcaaacccttctgtatgatgttaatggtaatttgaatggttttcgtgatcttaccactaacaagacttatacgataaggagctgttatagtggccgtgtttctgctgcatttcataaagatgcacccgaaccggctctgctctatcgtaatataaattgtagctatgtttttagcaataatatttcccgtgaggagaacccacttaattactttgatagttatttgggttgtgttgttaatgctgataaccgcacggatgaggcgcttcctaattgtgatctccgtatgggtgctggcttatgcgttgattattcaaaatcacgcagggctgaccgatcagtttctactggctatcggttaactacatttgagccatacactccgatgttagttaatgatagtgtccaatccgttgatggattatatgagatgcaaataccaaccaattttactattgggcaccatgaggagttcattcaaactagatctccaaaggtgactatagattgtgctgcatttgtctgtggtgataacactgcatgcaggcagcagttggttgagtatggctctttctgtgttaatgttaatgccattcttaatgaggttaataacctcttggataatatgcaactacaagttgctagtgcattaatgcagggtgttactataagctcgagactgccagacggcatctcaggccctatagatgacattaattttagtcctctacttggatgcataggttcaacatgtgctgaagacggcaatggacctagtgcaatccgagggcgttctgctatagaggatttgttatttgacaaggtcaaattatctgatgttggctttgtcgaggcttataataattgcaccggtggtcaagaagttcgtgacctcctttgtgtacaatcttttaatggcatcaaagtattacctcctgtgttgtcagagagtcagatctctggctacacaaccggtgctactgcggcagctatgttcccaccgtggtcagcagctgccggtgtgccatttagtttaagtgttcaatatagaattaatggtttaggtgtcactatgaatgtgcttagtgagaaccaaaagatgattgctagtgcttttaacaatgcgctgggtgctatccaggatgggtttgatgcaaccaattctgctttaggtaagatccagtccgttgttaatgcaaatgctgaagcactcaataacttactaaatcaactttctaacaggtttggtgctattagtgcttctttacaagaaattctaactcggcttgaggctgtagaagcaaaagcccagatagatcgtcttattaatggcaggttaactgcacttaatgcgtatatatccaagcaacttagtgatagtacgcttattaaagttagtgctgctcaggccatagaaaaggtcaatgagtgcgttaagagccaaaccacgcgtattaatttctgtggcaatggtaatcatatattatctcttgtccagaatgcgccttatggcttatattttatacacttcagctatgtgccaatatcctttacaaccgcaaatgtgagtcctggactttgcatttctggtgatagaggattagcacctaaagctggatattttgttcaagatgatggagaatggaagttcacaggcagttcatattactaccctgaacccattacagataaaaacagtgtcattatgagtagttgcgcagtaaactacacaaaggcacctgaagttttcttgaacacttcaatacctaatccacccgactttaaggaggagttagataaatggtttaagaatcagacgtctattgcgcctgatttatctctcgatttcgagaagttaaatgttactttgctggacctgacgtatgagatgaacaggattcaggatgcaattaagaagttaaatgagagctacatcaacctcaaggaagttggcacatatgaaatgtatgtgaaatggccttggtatgtttggttgctaattggattagctggtgtagctgtttgtgtgttgttattctttatatgttgctgcacaggttgtggctcatgttgttttaagaagtgtggaaattgttgtgatgagtatggaggacaccaggacagtattgtgatacataatatttcctctcatgaggattgactatcacagcctctcctggaaagacagaaaatctaaacaatttatagcattctcattgctacctggccccgtaagaggcagtcatagctatggccgtgttggtcctaaggctacattggctgctgtctttattggtccatttattgtagcatgtatgctaggcattggcctagtttatttattgcaattgcaagttcaaatttttcatgttaaggataccatacgtgtgactggcaagccagccactgtgtcttatactacaagtacaccagtaacaccgagcgcgacgacgctcgatggtactacgtatactttaattagacccactagctcttatacaagagtttatcttggtactccaagaggttttgattatagtacatttgggcctaagaccctagattatgttactaatctaaacctcatcttaattctggtcgtccatatacttttaaggcattgtccaggcatatgagaccaacagccacatggatttggcatgtgagtgatgcatggttacgccgcacgcgggactttggtgtcattcgcctagaagatttttgttttcaatttaattatagccaaccccgagttggttattgtagagttcctttaaaggcttggtgtagcaaccagggtaaatttgcagcgcagtttaccctaaaaagttgcgaaaaaccaggtcacgaaaaatttattactagcttcacggcctacggcagaactgtccaacaggccgttagcaagttagtagaagaagctgttgattttattctttttagggccacgcagctcgaaagaaatgtttaatttattccttacagacacagtatggtatgtggggcagattatttttatattcgcagtgtgtttgatggtcaccataattgtggttgccttccttgcgtctatcaaactttgtattcaactttgcggtttatgtaatactttggtgctgtccccttctatttatttgtatgataggagtaagcagctttataagtattataatgaagaaatgagactgcccctattagaggtggatgatatctaatctaaacattatgagtagtactactcaggccccagagcccgtctatcaatggacggccgacgaggcagttcaattccttaaggaatggaacttctcgttgggcattatactactctttattactatcatactacagttcggttacacgagccgtagcatgtttatttatgttgtgaaaatgataatcttgtggttaatgtggccactgactattgttttgtgtattttcaattgcgtgtatgcgctaaataatgtgtatcttggattttctatagtgtttactatagtgtccattgtaatctggattatgtattttgttaatagcataaggttgtttatcaggactggtagctggtggagcttcaaccccgaaacaaacaaccttatgtgtatagatatgaaaggtaccgtgtatgttagacccattattgaggattaccatacactaacagccactattattcgtggccacctctacatgcaaggtgttaagctaggcaccggtttctctttgtctgacttgcccgcttatgttacagttgctaaggtgtcacacctttgcacttataagcgcgcattcttagacaaggtagacggtgttagcggttttgctgtttatgtgaagtccaaggtcggaaattaccgactgccctcaaacaaaccgagtggcgcggacaccgcattgttgagaatctaatctaaactttaaggatgtcttttgttcctgggcaagaaaatgccggtggcagaagctcctctgtaaaccgcgctggtaatggaatcctcaagaagaccacttgggctgaccaaaccgagcgtggaccaaataatcaaaatagaggcagaaggaatcagccaaagcagactgcaactactcaacccaactccgggagtgtggttccccattactcctggttttctggcattacccagttccaaaagggaaaggagtttcagtttgcagaaggacaaggagtgcctattgccaatggaatccccgcttcagagcaaaagggatattggtatagacacaaccgccgttcttttaaaacacctgatgggcagcagaagcaattactgcccagatggtatttttactatcttggcacagggccccatgctggagccagttatggagacagcattgaaggtgtcttctgggttgcaaacagccaagcggacaccaatacccgctctgatattgtcgaaagggacccaagcagtcatgaggctattcctactaggtttgcgcccggcacggtattgcctcagggcttttatgttgaaggctctggaaggtctgcacctgctagccgatctggttcgcggtcacaatcccgtgggccaaataatcgcgctagaagcagttccaaccagcgccagcctgcctctactgtaaaacctgatatggccgaagaaattgctgctcttgttttggctaagctcggtaaagatgccggccagcccaagcaagtaacgaagcaaagtgccaaagaagtcaggcagaaaattttaaacaagcctcgccaaaagaggactccaaacaagcagtgcccagtgcagcagtgttttggaaagagaggccccaatcagaattttggaggctctgaaatgttaaaacttggaactagtgatccacagttccccattcttgcagagttggctccaacagttggtgccttcttctttggatctaaattagaattggtcaaaaagaattctggtggtgctgatgaacccaccaaagatgtgtatgagctgcaatattcaggtgcagttagatttgatagtactctacctggttttgagactatcatgaaagtgttgaatgagaatttgaatgcctaccagaaggatggtggtgcagatgtggtgagcccaaagccccaaagaaaagggcgtagacaggctcaggaaaagaaagatgaagtagataatgtaagcgttgcaaagcccaaaagctctgtgcagcgaaatgtaagtagagaattaaccccagaggatagaagtctgttggctcagatccttgatgatggcgtagtgccagatgggttagaagatgactctaatgtgtaaagagaatgaatcctatgtcggcgctcggtggtaacccctcgcgagaaagtcgggataggacactctctatcagaatggatgtcttgctgtcataacagatagagaaggttgtggcagaccctgtatcaattagttgaaagagattgcaaaatagagaatgtgtgagagaagttagcaaggtcctacgtctaaccataagaacggcgataggcgccccctgggaagagctcacatcagggtactattcctgcaatgccctagtaaatgaatgaagttgatcatggccaattggaagaatcacaaaaaaaaaaaaaaaaaaaaaaa

SEQ ID NO: 38 - DNA, 31357 bp, Coronavirus; identical to SEQ ID NO: 37

SEQ ID NO: 39 - DNA, 31233 bp, Coronavirus
attggcgtccgtacgtaccctttctactctcaaactcttgttagtttaaatctaatctaaactttataaacggcacttcctgtgtgtccatgcccgtgggcttggtcttgtcatagtgctgacatttgtggttccttggtttttgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtagccctgagaggtcagaggaggatgggttttgcccctctgctgcgcaagaaccaaaaactaaaggaaaaactttggttaatcacgtgagggtgaattgtagccggcttccagctttggaatgctgtgttcagtctgccataatccgtgatatttttgtagatgaggatccccagaaggtggaggcctcaactatgatggcattgcagttcggtagtgccgtcttggttaagccatccaagcgcttgtctattcaggcatggactaatttgggtgtgcttcccaaaacagctgccatggggttgttcaagcgcgtctgcctgtgtaacaccagggagtgctcttgtgacgcccacgtggcctttcacctttttacggtccaacccgatggtgtatgcctgggtaatggccgttttataggctggttcgttccagtcacagccataccggagtatgcgaagcagtggttgcaaccctggtccatccttcttcgtaagggtggtaacaaagggtctgtgacatccggccacttccgccgcgctgttaccatgcctgtgtatgactttaatgtagaggatgcttgtgaggaggttcatcttaacccgaagggtaagtactcctgcaaggcgtatgctcttcttaagggctatcgcggtgttaagcccatcctgtttgtggaccagtatggttgcgactatactggatgtctcgccaagggtcttgaggactatggcgatctcaccttgagtgagatgaaggagttgttccctgtgtggcgtgactccttggatagtgaagtccttgtggcttggcacgttgatcgagatcctcgggctgctatgcgtctgcagactcttgctactgtacgttgcattgattatgtgggccaaccgaccgaggatgtggtggatggagatgtggtagtgcgtgagcctgctcatcttctcgcagccaatgccattgttaaaagactcccccgtttggtggagactatgctgtatacggattcgtccgttacagaattctgttataaaaccaagctgtgtgaatgcggttttatcacgcagtttggctatgtggattgttgtggtgacacctgcgattttcgtgggtgggttgccggcaatatgatggatggctttccatgtccagggtgtaccaaaaattatatgccctgggaattggaggcccagtcatcaggtgttataccagaaggaggtgttctattcactcagagcactgatacagtgaatcgtgagtcctttaagctctacggtcatgctgttgtgccttttggttctgctgtgtattggagcccttgcccaggtatgtggcttccagtaatttggtcttctgttaagtcatactctggtttgacttatacaggagtagttggttgtaaggcaattgttcaagagacagacgctatatgtcgttctctgtatatggattatgtccagcacaagtgtggcaatctcgagcagagagctatccttggattggacgatgtctatcatagacagttgcttgtgaataggggtgactatagtctcctccttgagaatgtggatttgtttgttaagcggcgcgctgaatttgcttgcaaattcgccacctgtggagatggtcttgtacccctcctactagatggtttagtgccccgcagttattatttgattaagagtggtcaagctttcacctctatgatggttaattttagccatgaggtgactgacatgtgtatggacatggctttattgttcatgcatgatgttaaagtggccactaagtatgttaagaaggttactggcaaactggccgtgcgctttaaagcgtggggtgtagccgttgtcagaaaaattactgaatggtttgatttagccgtggacattgctgctagtgccgctggatggctttgctaccagctggtaaatggcttatttgcagtggccaatggtgttataacctttgtacaggaggtgcctgagcttgtcaagaattttgttgacaagttcaaggcatttttcaaggttttgatcgactctatgtcggtttctatcttgtctggacttactgttgtcaagactgcctcaaatagggtgtgtcttgctggcagtaaggtttatgaagttgtgcagaaatctttgtctgcatatgttatgcctgtgggttgcagcgaagccacttgtttggtgggtgagattgaacctgcagtttttgaagatgatgttgttgatgtggttaaagccccattaacatatcaaggctgttgtaagccacccacttctttcgagaagatttgtattgtggataaattgtatatggccaagtgtggtgatcaattttaccctgtggttgttgataacgacactgttggcgtgttagatcagtgctggaggtttccctgtgcgggcaagaaagtcgagtttaacgacaagcccaaagtcaggaagataccctccacccgtaagattaagatcaccttcgcactggatgcgacctttgatagtgttctttcgaaggcgtgttcagagtttgaagttgataaagatgttacattggatgagctgcttgatgttgtgcttgacgcagttgagagtacgctcagcccttgtaaggagcatgatgtgataggcacaaaagtttgtgctttacttgataggttggcaggagattatgtctatctttttgatgagggaggcgatgaagtgatcgccccgaggatgtattgttccttttctgctcctgatgatgaagactgcgttgcagcggatgttgtagatgcagatgaaaaccaagatgatgatgctgaagactcagcagtccttgtcgctgatacccaagaagaggacggcgttgccaaggggcaggttgaggcggattcggaaatttgcgttgcgcatactggtagtcaagaagaattggctgagcctgatgctgtcggatctcaaactcccatcgcctctgctgaggaaaccgaagtcggagaggcaagcgacagggaagggattgctgaggcgaaggcaactgtgtgtgctgatgctgtagatgcctgccccgatcaagtggaggcatttgaaattgaaaaggttgaagactctatcttggatgagcttcaaactgaacttaatgcgccagcggacaagacctatgaggatgtcttggcattcgatgccgtatgctcagaggcgttgtctgcattctatgctgtgccgagtgatgagacgcactttaaagtgtgtggattctattcgcctgctatagagcgcactaattgttggctgcgttctactttgatagtaatgcagagtctacctttggaatttaaagacttggagatgcaaaagctctggttgtcttacaaggccggctatgaccaatgctttgtggacaaactagttaagagcgtgcccaagtctattatccgtccacaaggtggttatgtggcagattttgcctatttctttctaagccagtgtagctttaaagcttatgctaactggcgttgtttagagtgtgacatggagttaaagcttcaaggcttggacgccatgtttttctatggggacgttgtgtctcatatgtgcaagtgtggtaatagcatgaccttgttgtctgcagatataccctacactttgcattttggagtgcgagatgataagttttgcgctttttacacgccaagaaaggtctttagggctgcttgtgcggtagatgttaatgattgtcactctatggctgtagtagagggcaagcaaattgatggtaaagtggttaccaaatttattggtgacaaatttgattttatggtgggttacgggatgacatttagtatgtctccttttgaactcgcccagttatatggttcatgtataacaccaaatgtttgttttgttaaaggagatgttataaaggttgttcgcttagttaatgctgaagtcattgttaaccctgctaatgggcgtatggctcatggtgcaggtgttgcaggtgctatagctgaaaaggcgggcagtgcttttattaaagaaacctccgatatggtgaaggctcagggcgtttgccaggttggtgaatgctatgaatctgccggtggtaagttatgtaaaaaggtgcttaacattgtagggccagatgcgcgagggcatggcaagcaatgctattcacttttagagcgtgcttatcagcatattaataagtgtgacaatgttgtcactactttaatttcggctggtatatttagtgtgcctactgatgtctccctaacttacttacttggtgtagtgacaaagaatgtcattcttgtcagtaacaaccaggatgattttgatgtgatagagaagtgtcaggtgacctccgttgctggtaccaaagcgctatcacttcaattggccaaaaatttgtgccgtgatgtaaagtttgtgacgaatgcatgtagttcgctttttagtgaatcttgctttgtctcaagctatgatgtgttgcaggaagttgaagcgctgcgacatgatatacaattggatgatgatgctcgtgtctttgtgcaggctaatatggactgtctgcccacagactggcgtctcgttaacaaatttgatagtgttgatggtgttagaaccattaagtattttgaatgcccgggcgggatttttgtatccagccagggcaaaaagtttggttatgttcagaatggttcatttaaggaggcgagtgttagccaaataagggctttactcgctaataaggttgatgtcttgtgtactgttgatggtgttaacttccgctcctgctgcgtagcagagggtgaagtttttggcaagacattaggttcagtcttttgtgatggcataaatgtcaccaaagttaggtgtagtgccatttacaagggtaaggttttctttcagtacagtgatttgtccgaggcagatcttgtggctgttaaagatgcctttggttttgatgaaccacaactgctgaagtactacactatgcttggcatgtgtaagtggccagtagttgtttgtggcaattattttgctttcaagcagtcaaataataattgctatataaatgtggcatgtttaatgctgcaacacttgagtttaaagtttcctaagtggcaatggcaagaggcttggaacgagttccgctctggtaaaccactaaggtttgtgtccttggtattagcaaagggcagctttaaatttaatgaaccttctgattctatcgattttatgcgtgtggtgctacgtgaagcagatttgagtggtgccacgtgcaatttggaatttgtttgtaaatgtggtgtgaagcaagagcagcgcaaaggtgttgacgctgttatgcattttggtacgttggataaaggtgatcttgtcaggggttataatatcgcatgtacgtgcggtagtaaacttgtgcattgcacccaatttaacgtaccatttttaatttgctccaacacaccagagggtaggaaactgcccgacgatgttgttgcagctaatatttttactggtggtagtgtgggccattacacgcatgtgaaatgtaaacccaagtaccagctttatgatgcttgtaatgttaataaggtttcggaggctaagggtaattttaccgattgcctctaccttaaaaatttaaagcaaactttttcgtctgtgctgacgactttttatttagatgatgtaaagtgtgtggagtataagccagatttatcgcagtattactgtgagtctggtaaatattatacaaaacccattattaaggcccaatttagaacatttgagaaggttgatggtgtctataccaactttaaattggtgggacatagtattgctgaaaaactcaatgctaagctgggatttgattgtaattctccctttgtggagtataaaattacagagtggccaacagctactggagatgtggtgttggctagtgatgatttgtatgtgagtcggtactcaagcgggtgcattacttttggtaaaccggttgtctggcttggccatgaggaagcatcgctgaaatctctcacatattttaatagacctagtgtcgtttgtgaaaataaatttaatgtgttgcccgttgatgtcagtgaacccacggacaaggggcctgtgcctgctgcagtccttgttaccggcgtccctggagctgatgcgtcagctggtgccggtattgccaaggagcaaaaagcctgtgcttctgctagtgtggaggatcaggttgttacggaggttcgtcaagagccatctgtttcagctgctgatgtcaaagaggttaaattgaatggtgttaaaaagcctgttaaggtggaaggtagtgtggttgttaatgatcccactagcgaaaccaaagttgttaaaagtttgtctattgttgatgtctatgatatgttcctgacagggtgtaagtatgtggtttggactgctaatgagttgtctcgactagtaaattcaccgactgttagggagtatgtgaagtggggtatgggaaagattgtaacacccgctaagttgttgttgttaagagatgagaagcaagagttcgtagcgccaaaagtagtcaaggcgaaagctattgcctgctattgtgctgtgaagtggtttctcctctattgttttagttggataaagtttaatactgataataaggttatatacaccacagaagtagcttcaaagcttactttcaagttgtgctgtttggcctttaagaatgccttacagacgtttaattggagcgttgtgtctaggggctttttcctagttgcaacggtctttttattatggtttaactttttgtatgctaatgttattttgagtgacttctatttgcctaatattgggcctctccctacgtttgtgggacagatagttgcgtggtttaagactacatttggtgtgtcaaccatctgtgatttctaccaggtgacggatttgggctatagaagttcgttttgtaatggaagtatggtatgtgaactatgcttctcaggttttgatatgctggacaactatgatgctataaatgttgttcaacacgttgtagataggcgtttgtcctttgactatattagcctatttaaattagtagttgagcttgtaatcggctactctctttatactgtgtgcttctacccactgtttgtccttattggaatgcagttgttgaccacatggttgcctgaattctttatgctggagactatgcattggagtgctcgtttgtttgtgtttgttgccaatatgcttccagcttttacgttactgcgattttacatcgtggtgacagctatgtataaggtctattgtctttgtagacatgttatgtatggatgtagtaagcctggttgcttgttttgttataagagaaaccgtagtgtccgtgttaagtgtagcaccgttgttggtggttcactacgctattacgatgtaatggctaacggcggcacaggtttctgtacaaagcaccagtggaactgtcttaattgcaattcctggaaaccaggcaatacattcataactcatgaagcagcggcggacctctctaaggagttgaaacgccctgtgaatccaacagattctgcttattactcggtcacagaggttaagcaggttggttgttccatgcgtttgttctacgagagagatggacagcgtgtttatgatgatgttaatgctagtttgtttgtggacatgaatggtctgctgcattctaaagttaaaggtgtgcctgaaacgcatgttgtggttgttgagaatgaagctgataaagctggttttctcggcgccgcagtgttttatgcacaatcgctctacagacctatgttgatggtggaaaagaaattaataactaccgccaacactggtttgtctgttagtcgaactatgtttgacctttatgtagattcattgctgaacgtcctcgacgtggatcgcaagagtctaacaagttttgtaaatgctgcgcacaactctctaaaggagggtgttcagcttgaacaagttatggatacctttattggctgtgcccgacgtaagtgtgctatagattctgatgttgaaaccaagtctattaccaagtccgtcatgtcggcagtaaatgctggcgttgattttacggatgagagttgtaataacttggtgcctacctatgttaaaagtgacactatcgttgcagccgatttgggtgttcttattcagaataatgctaagcatgtacaggctaatgttgctaaagccgctaatgtggcttgcatttggtctgtggatgcttttaaccagctatctgctgacttacagcataggctgcgaaaagcatgttcaaaaactggcttgaagattaagcttacttataataagcaggaggcaaatgttcctattttaactacaccgttctctcttaaagggggcgctgtttttagtagaatgttacaatggttgtttgttgctaatttgatttgtttcattgtgttgtgggcccttatgccaacatatgcagtgcacaaatcggatatgcagttgcctttatatgccagttttaaagttatagataatggtgtgctaagggatgtgtctgttactgacgcatgcttcgcaaacaaatttaatcaatttgatcaatggtatgagtctacttttggtcttgcttattaccgcaactctaaggcttgtcctgttgtggttgctgtaatagatcaagacattggccataccttatttaatgttcctaccacagttttaagatatggatttcatgtgttgcattttataacccatgcatttgctactgatagcgtgcagtgttacacgccacatatgcaaatcccctatgataatttctatgctagtggttgcgtgttgtcatccctctgtactatgcttgcgcatgcagatggaaccccgcatccttattgttatacagggggtgttatgcacaatgcctctctgtatagttctttggctcctcatgtccgttataacctggctagttcaaatggttatatacgttttcccgaagtggttagtgaaggcattgtgcgtgttgtgcgcactcgctctatgacctactgcagggttggtttatgtgaggaggccgaggagggtatctgctttaattttaatcgttcatgggtattgaacaacccgtattatagggccatgcctggaactttttgtggtaggaatgcttttgatttaatacatcaagttttaggaggattagtgcggcctattgatttctttgccttaacggcgagttcagtggctggtgctatccttgcaattattgtcgttttggctttctattatttaataaagcttaaacgtgcctttggtgactacactagtgttgtggttatcaatgtaattgtgtggtgtataaattttctgatgctttttgtgtttcaggtttatcccacattgtcttgtttatatgcttgtttttatttctacacaacgctttatttcccttcggagataagtgttgttatgcatttgcaatggcttgtcatgtatggtgctattatgcccttgtggttttgcattatttacgtggcagtcgttgtttcaaaccatgcattgtggttgttctcttactgccgcaaaattggtaccgaggttcgtagtgacggcacatttgaggaaatggcccttactacctttatgattactaaagaatcttattgtaagttgaaaaattctgtttctgatgttgcttttaacaggtacttgagtctttataacaagtatcgttattttagtggcaaaatggatactgccgcttatagagaggctgcctgttcacaactggcaaaggcaatggaaacatttaaccataataatggtaatgatgttctctatcagcctccaaccgcctctgttactacatcatttttacagtctggtatagtgaagatggtgtcgcccacctctaaagtggagccttgtattgttagtgttacttatggtaacatgacacttaatgggttgtggttggatgataaagtttattgcccaagacatgttatctgttcttcagctgacatgacagaccctgattatcctaatttgctttgtagagtgacatcaagtgatttttgtgttatgtctggtcgtatgagccttactgtaatgtcttatcaaatgcagggctgccaacttgttttgactgttacactgcaaaatcctaacacgcctaagtattccttcggtgttgttaagcctggtgagacatttactgtactggctgcatacaatggcagacctcaaggagccttccatgttacgcttcgtagtagccataccataaagggctcctttctatgtggatcctgcggttctgtaggatatgttttaactggcgatagtgtacgatttgtttatatgcatcagctagagttgagtactggttgtcataccggtactgactttagtgggaacttttatggtccctatagagatgcgcaagttgtacaattgcctgttcaggattatacgcagactgttaatgttgtagcttggctttatgctgctatttttaacagatgcaactggtttgtgcaaagtgatagttgttccctggaggagtttaatgtttgggctatgaccaatggttttagctcaattaaagccgatcttgtcttggatgcgcttgcttctatgacaggcgttacagttgaacaggtgttggccgctattaagaggctgcattctggattccagggcaaacaaattttaggtagttgtgtgcttgaagatgagctgacaccaagtgatgtttatcaacaactagctggtgtcaagctacagtcaaagcgcacaagagttataaaaggtacatgttgctggatattggcttcaacgtttttgttctgtagcattatctcagcatttgtaaaatggactatgtttatgtatgttactacccatatgttgggagtgacattgtgtgcactttgttttgtaagctttgctatgttgttgatcaagcataagcatttgtatttaactatgtatattatgcctgtgttatgcacactgttttacaccaactatttggttgtgtacaaacagagttttagaggtctagcttatgcttggctttcacactttgtccctgctgtagattatacatatatggatgaagttttatatggtgttgtgttgctagtagctatggtgtttgttaccatgcgtagcataaaccacgacgtcttttctattatgttcttggttggtagacttgtcagcctggtatccatgtggtattttggagccaatttagaggaagaggtactattgttcctcacatccctatttggcacgtacacatggactactatgttgtcattggctaccgctaaggttattgctaaatggttggctgtgaatgtcttgtacttcacagacgtaccgcaaattaaattagttcttttgagctacttgtgtattggttatgtgtgttgttgttattggggaatcttgtcactccttaatagcatttttaggatgccatttggcgtctacaattataaaatctccgttcaggagttacgttatatgaatgctaatggcttgcgcccacctagaaatagttttgaggccctgatgcttaattttaagctgttgggaattggtggtgtgccagtcattgaagtatctcaaattcaatcaagattgacggatgttaaatgtgctaatgttgtgttgcttaattgcctccagcacttgcatattgcatctaattctaagttgtggcagtattgtagtactttgcacaatgaaatactggctacatctgatttgagcgtggccttcgataagttggctcagctcttagttgttttatttgctaatccagcagcagtggatagcaagtgccttgcaagtattgaagaagtgagcgatgattacgttcgcgacaatactgtcttgcaagccttacagagtgaatttgttaatatggctagcttcgttgagtatgaacttgctaagaagaatctagatgaggctaaggctagcggctctgccaatcaacagcagattaagcagctagagaaggcgtgtaatattgctaagtcagcatatgagcgcgacagagctgttgctcgtaagctggaacgtatggctgatttagctcttacaaacatgtataaagaagctagaattaatgataagaagagtaaggtagtgtctgcattgcaaaccatgctctttagtatggtgcgtaagctagataaccaagctcttaattctattttagataatgcagttaagggttgtgtacctttgaatgcaataccatcattgacttcgaacactctgactataatagtgccagataagcaggtttttgatcaggttgtggataatgtgtatgtcacctatgctgggaatgtatggcatatacagtttattcaagatgctgatggtgctgttaaacaattgaatgagatagatgttaattcaacctggcctctagtcattgctgcaaataggcataatgaagtgtctactgttgttttgcagaacaatgagttgatgcctcagaagttgagaactcaggttgtcaatagtggctcagatatgaattgtaatactcctacccagtgttactataatactactggcacgggtaagattgtgtatgctatacttagtgactgtgatggtctcaagtacactaagatagtaaaagaagatggaaattgtgttgttttggaattggatcctccctgtaagttttctgttcaggatgtgaagggccttaaaattaagtacctttactttgtgaaggggtgtaatacactggctagaggctgggttgtaggcaccttatcctcgacagtgagattgcaggcgggtacggcaactgagtatgcctgcaactctgcaatactgtcgctgtgtgcgttttctgtagatcctaagaaaacgtacttggattatataaaacagggtggagttcccgttactaattgtgttaagatgttatgtgaccatgctggcactggtatggccattactattaagccggaggcaaccactaatcaggattcttatggtggtgcttccgtttgtatatattgccgctcgcgtgttgaacatccagatgttgatggattgtgcaaattacgcggcaagtttgtccaagtgcccttaggcataaaagatcctgtgtcatatgtgttgacgcatgatgtttgtcaggtttgtggcttttggcgagatggtagctgttcctgtgtaggcacaggctcccagtttcagtcaaaagacacgaactttttaaacggattcggggtacaagtgtaaatgcccgtcttgtaccctgtgccagtggcttggacactgatgttcaattaagggcatttgacatttgtaatgctaatcgagctggcattggtttgtattataaagtgaattgctgccgcttccagcgtgtagatgaggacggcaacaagttggataagttctttgttgttaaaagaactaatttagaagtgtataataaggagaaagaatgctatgagttgacaaaagaatgcggtgttgtggctgaacacgagttcttcacatttgatgtggagggaagtcgggtaccacacatagtccgtaaagatctttcaaagtttactatgttagatctttgctatgcattgcgtcattttgaccgcaatgattgttcaactcttaaggaaattctccttacatatgctgagtgtgaagagtcctacttccaaaagaaggactggtatgattttgttgagaatcctgatataattaatgtgtataaaaagcttggtcctatatttaatagagccctgcttaacactgccaagtttgcagacgcattagtggaggcaggcttagtaggtgttttaacacttgataatcaagatttatatggtcaatggtatgactttggagattttgtcaagacagtacctggttgtggtgttgccgtggcagactcttattattcatatatgatgccaatgctgactatgtgtcatgcgttggatagtgagttgtttgttaatggtacttatagggagtttgaccttgttcagtatgattttactgatttcaagctagagctcttcactaagtattttaagcattggagtatgacctaccacccgaacacctgtgagtgcgaggatgacaggtgcattattcattgcgccaattttaatatactttttagtatggtcttacctaagacctgttttgggcctcttgttaggcagatatttgtggatggtgttcctttcgttgtgtcgatcggttaccattataaagaattaggtgttgttatgaatatggatgtggatacacatcgttatcgcttgtctcttaaggacttgcttttgtatgctgcagaccctgcccttcatgtggcgtctgctagtgcactgcttgatttgcgcacatgttgttttagcgttgcagctattacaagtggcgtaaaatttcaaacagttaaacctggaaattttaatcaggatttttatgagtttattttgagtaaaggcctgcttaaagaggggagctccgttgatttgaagcacttcttctttacgcaggatggtaatgctgctattactgattataattattacaagtataatctacccaccatggtggatattaagcagttgttgtttgttttagaagttgttaataagtattttgagatctatgagggtgggtgtatacccgcaacacaggtcattgttaataattatgataagagtgctggctatccatttaataaatttggaaaggccaggctctattatgaggcattatcatttgaggagcaggatgaaatttatgcgtataccaaacgcaatgtcctgccgaccctaactcaaatgaatcttaaatatgctattagtgctaagaatagggcccgcaccgttgctggtgtctctattctcagtactatgactggcagaatgtttcatcaaaagtgtctaaagagtatagcagctactcgcggtgttcctgtagttataggcaccacgaagttctatggcggttgggatgatatgttacgccgccttattaaagatgttgatagtcctgtactcatgggttgggactatcctaaatgtgatcgtgctatgccaaacatactgcgtattgttagtagtttggtgctagtccgtaaacatgattcgtgctgttcgcatacggatagattctatcgtcttgcgaacgagtgcgcccaagttttgagtgaaattgttatgtgtggtggttgttattatgttaaaccaggtggcactagtagtggggatgcaaccactgcttttgctaattctgtgtttaacatttgtcaagctgtttccgccaatgtatgctcgcttatggcatgcaatggacacaaaattgaagatttgagtatacgcgagttacaaaagcgcctatactctaatgtctatcgtgcggaccatgttgaccccgcatttgttagtgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggccaaatgttgggtagaaacagacatcgaaaagggaccgcatgaattttgttctcaacatacaatgctagtcaagatggatggtgatgaagtctaccttccataccctgatccttcgagaatcttaggagcaggctgttttgttgatgatttattaaagactgatagcgttctcttgatagagcgtttcgtaagtcttgcaattgatgcttatcctttagtataccatgagaacccagagtatcaaaatgtgttccgggtatatttagaatatataaagaagctgtacaatgatctcggtaatcagatcctggacagctacagtgttattttaagtacttgtgatggtcaaaagtttactgatgagaccttttacaagaacatgtatttaagaagtgcagtgctgcaaagcgttggtgcctgcgttgtctgtagttctcaaacatcattacgttgtggcagttgcatacgcaagcctttgctgtgttgcaaatgcgcctatgatcatgttatgtccactgatcataaatatgtcctgagtgtgtcaccatatgtgtgtaattcaccgggatgtgatgtaaatgatgttaccaaattgtatttaggtggtatgtcatattattgtgaggaccataaaccacagtattcattcaaattggtgatgaatggtatggtttttggtttatataaacaatcttgtactggttcgccctacatagaggattttaataaaatagctagttgcaaatggacagaagtcgatgattatgtgctagctaatgaatgcaccgaacgccttaaattgtttgccgcagaaacgcagaaggccacagaagaggcctttaagcaatgttatgcgtcagcaacgatccgtgagatcgtgagcgatcgggagttaattttatcttgggaaattggtaaagtgagaccaccacttaataaaaattatgtttttactggctaccattttactaataatggtaagacagttttaggtgagtatgtttttgataagagtgagttgactaatggtgtgtattatcgcgccacaaccacttataagttatctgtaggtgatgtgttcattttaacatcacacgcagtgtctagtttaagtgctcctacattagtaccgcaggagaattatactagcattcgttttgctagtgtttatagtgtgcctgagacgtttcagaataatgtgcctaattatcagcacattggaatgaagcgctattgtactgtacagggaccgcctggtactggtaagtcccatctagccattgggctagctgtttattattgtacagcgcgcgtggtgtataccgctgctagccatgctgcagttgacgcgctgtgtgaaaaggcacataaatttttaaatattaatgactgcacgcgtattgttcctgcaaaggtgcgtgtagattgttatgataaatttaaggtcaatgacaccactcgcaagtatgtgtttactacaataaatgcattacctgagttggtgactgacattattgtcgttgatgaagttagtatgcttaccaactatgagctgtctgttattaacagtcgtgttagggctaagcattatgtgtatattggagaccctgcgcagttacctgcaccacgtgtgctactgaataagggaactctagaacctagatattttaattccgttaccaagctaatgtgttgtttgggtccagatattttcttgggcacctgttatagatgccctaaggagattgtggatacggtgtcagccttggtttataataataagctgaaggctaaaaatgataatagctccatgtgctttaaggtttattataagggccagactacacatgagagttctagtgctgttaatatgcagcaaatacatttaattagtaagtttttaaaggcaaaccccagttggagtaacgccgtatttattagtccttataatagtcagaactatgttgctaagagagtcttgggattacaaacccagacagtagactcagcgcagggttctgaatatgattttgttatttattcacagactgcggaaacagcgcattctgtcaatgtaaatagattcaatgttgctattacacgtgctaagaagggtattctttgtgtcatgagtagtatgcaattatttgagtctcttaattttactacactgacgttggataagattaacaatccacgattacagtgtactacaaatttgtttaaggattgtagcaggagctatgtaggatatcacccagcccatgcaccatcctttttggcagttgatgacaaatataaggtaggcggtgatttagccgtttgccttaatgttgctgattctgctgtcagttattcgcggcttatatcactcatgggattcaagcttgacttgacccttgatggttattgtaagctgtttataactagagatgaagctatcaaacgtgttagagcctgggttggcttcgatgcagaaggtgcccatgcgatacgtgatagcattgggacaaatttcccattacaattaggcttttcgactggaattgattttgttgtcgaagccactggaatgtttgctgagagagatggttatgtctttaaaaaggcagccgcacgagctcctcctggcgaacaatttaaacaccttatcccacttatgtcaagagggcagaaatgggatgtggttcgaattagaatagtacaaatgttgtcagaccacctagtggatttggcagacagtgttgtacttgtgacgtgggctgccagctttgagctcacatgtttgcgatatttcgctaaagttggaagagaagttgtgtgtagtgtctgcaccaagcgtgcgacatgttttaattctagaactggatactatggatgctggcgacatagttattcctgtgattacctgtacaacccactaatagttgacattcaacagtggggatatacaggatctttaactagcaatcatgatcctatttgcagcgtgcataagggtgctcatgttgcatcatctgatgctatcatgacccggtgtctagctgttcatgattgcttttgtaagtctgttaattggaatttagaataccccattatttcaaatgaggtcagtgttaatacctcctgcaggttattgcagcgcgtaatgtttagggctgcgatgctatgcaataggtatgatgtgtgttatgacattggcaaccctaaaggtcttgcctgtgtcaaaggatatgattttaagttttatgatgcctcccctgttgttaagtctgttaaacagtttgtttataaatacgaggcacataaagatcaatttttagatggtttgtgtatgttttggaactgcaatgtggataagtatccagcgaatgcagttgtgtgtaggtttgacacgcgtgtgttgaacaaattaaatctccctggctgtaatggtggcagtttgtatgttaacaaacatgcattccacaccagtccctttacccgggctgccttcgagaatttgaagcctatgcctttcttttattattcagatacgccctgtgtgtatatggaaggcatggaatctaagcaggtcgattatgtcccattgagaagcgctacatgcatcacaagatgcaatttaggtggcgctgtttgtttaaaacatgctgaggagtatcgtgagtaccttgagtcttacaatacggcaaccacagcgggttttactttttgggtctataagacttttgatttttataacctttggaatacttttactaggctccaaagtttagaaaatgtagtgtataatttggtcaatgctggacactttgatggccgggcgggtgaactgccttgtgctgttataggtgagaaagtcattgccaagattcaaaatgaggatgtcgtggtctttaaaaataacacgccattccccactaatgtggctgtcgaattatttgctaagcgcagtattcggccccaccccgagcttaagctctttagaaatttgaatattgacgtgtgctggagtcacgtcctttgggattatgctaaggatagtgtgttttgcagttcgacgtataaggtctgcaaatacacagatttacagtgcattgaaagcttgaatgtactttttgatggtcgtgataatggtgctcttgaagcttttaagaagtgccggaatggcgtctacattaacacgacaaaaattaaaagtctgtcgatgattaaaggcccacaacgtgccgatttgaatggcgtagttgtggagaaagttggagattctgatgtggaattttggtttgctgtgcgtaaagacggtgacgatgttatcttcagccgtacagggagccttgaaccgagccattaccggagcccacaaggtaatccgggtggtaatcgcgtgggtgatctcagcggtaatgaagctctagcgcgtggcactatctttactcaaagcagattattatcttctttcacacctcgatcagagatggagaaagattttatggatttagatgatgatgtgttcattgcaaaatatagtttacaggactacgcgtttgaacacgttgtttatggtagttttaaccagaagattattggaggtttgcatttgcttattggcttagcccgtaggcagcaaaaatccaatctggtaattcaagagttcgtgacatacgactctagcattcattcgtactttatcactgacgagaacagtggtagtagtaagagtgtgtgcactgttattgatttattgttagatgattttgtggacattgtaaagtccctgaatctaaagtgtgtgagtaaggttgttaatgttaatgttgattttaaagatttccagtttatgttgtggtgcaatgaggagaaggtcatgactttctatcctcgtttgcaggctgctgctgactggaaacctggttatgttatgcctgtcttatataagtatttggaatcgcctctggaaagagtaaacctctggaattatggcaagccgattactttacctacaggatgtatgatgaatgttgctaagtatactcaattatgtcaatatttgagcactacaacattagcagttccggctaatatgcgtgtcttacaccttggtgccggttcggataagggtgttgcccctgggtctgcagttcttaggcagtggctaccagcgggaagtattcttgtagataatgatgtgaatccatttgtgagtgacagtgtcgcctcatattatggaaattgtataaccttaccctttgattgtcagtgggatctgataatttctgatatgtacgaccctcttactaagaacattggggagtacaacgtgagtaaagatggattctttacttacctctgtcatttaattcgtgacaagttggctctgggtggcagtgttgccataaaaataacagagttttcttggaacgctgagttatatagtttaatggggaagtttgcgttctggacaatcttttgcaccaacgtaaacgcctcttcaagtgaaggatttttgattggcataaattggttgaataagacccgtaccgaaattgacggtaaaaccatgcatgccaattatctgttttggagaaatagtacaatgtggaatggaggggcttacagtctctttgacatgagtaagttccctttgaaagcggctggtacggctgttgttagccttaaaccagaccaaataaatgacttagtcctctccttgattgagaagggcaagttattagtgcgtgatacacgcaaagaagtttttgttggcgatagcctagtaaatgtcaaataaatctatacttgtcgtggctgtgaaaatggcctttgctgacaagcctaatcatttcataaactttcccctggcccaatttagtggctttatgggtaagtatttaaagctacagtctcaacttgtggaaatgggtttagactgtaaattacagaaggcaccacatgttagtattaccctgcttgatattaaagcagaccaatacaaacaggtggaatttgcaatacaagaaataatagatgatctggcggcatatgagggagatattgtctttgacaaccctcacatgcttggcagatgccttgttcttgatgttagaggatttgaagagttgcatgaagatattgttgaaattctccgcagaaggggttgcacggcagatcaatccagacactggattccgcactgcactgtggcccaatttgacgaagaaagagaaacaaaaggaatgcaattctatcataaagaacccttctacctcaagcataacaacctattaacggatgctgggcttgagctcgtgaagataggttcttccaaaatagatgggttttattgtagtgaactgagtgtttggtgtggtgagaggctttgttataagcctccaacacccaaattcagtgatatatttggctattgctgcatagataaaatacgtggtgatttagaaataggagacctaccgcaggatgatgaggaagcgtgggccgagctaagttaccactatcaaagaaacacctacttcttcagacatgtgcacgataatagcatctattttcgtaccgtgtgtagaatgaagggttgtatgtgttgatttgtttttacactattagtgtaataagcttattattttgttgaaaagggcaggatgtgcatagctatggctcctcgcacactgcttttgctgatttgatgtcagctggtgtttgggttcaatgaacctcttaacatcgtttcacatttaaatgatgactggtttctatttggtgacagtcgttctgactgtacctatgtagaaaataacggtcatcctaaattagattggcttgacctcgacccaaagttgtgtaattcaggaaagatttccgcaaagagtggtaactctctctttaggagttttcacttcactgatttttacaattatacgggtgagggagaccaaattgtattttatgaaggagttaattttagtcccagccatggctttaaatgcctggctcatggagataataaaagatggatgggcaataaagctcgattttatgcccgagtgtatgagaagatggcccaatataggagcctatcgtttgttaatgtgtcttatgcctatggaggtaatgcaaagcccgcctccatttgcaaagacaatactttaacactcaataaccccaccttcatatcgaaggagtctaattatgttgattagtaccgctctgtggtttaatggccattccaagggcagctcttcggatgctgccaataaatattatactgactctcagagttactataatatggatattggtgtcttatatgggttcaattcgaccttggatgttggcaacactgctaaggatccgggtcttgatctcacttgcaggtatcttgcattgactcctggtaattataaggctgtgtccttagaatatttgttaagcttaccctcaaaggctatttgcctccataagacaaagcgctttatgcctgtgcaggtagttgactcaaggtggagtagcatccgccagtcagacaatatgaccgctgcagcctgtcagctgccatattgtttctttcgcaacacatctgcgaattatagtggtggcacacatgatgcgcaccatggtgattttcatttcaggcagttattgtctggtttgttatataatgtttcctgtattgcccagcagggtgcatttctttataataatgttagttcctcttggccagcctatgggtacggtcattgtccaacggcagctaacattggttatatggcacctgtttgtatctatgaccctctcccggtcatactgctaggtgtgttattgggtatagctgtgttgattattgtgtttttgatgttttattttatgacggatagcggtgttagattgcatgaggcataatctaaacatgctgttcgtgtttattctatttttgccctcttgtttagggtatattggtgattttagatgtatccagcttgtgaattcaaacggtgctaatgttagtgctccaagcattagcactgagaccgttgaagtttcacaaggcctggggacatattatgtgttagatcgagtttatttaaatgccacattattgcttactggttactacccggtcgatggttctaagtttagaaacctcgctcttacgggaactaactcagttagcttgtcgtggtttcaaccaccctatttaagtcagtttaatgatggcatatttgcgaaggtgcagaaccttaagacaagtacgccatcaggtgcaactgcatattttcctactatagttataggtagtttgtttggctatacttcctataccgttgtaatagagccatataatggtgttataatggcctcagtgtgccagtataccatttgtcagttaccttacactgattgtaagcctaacactaatggtaataagcttatagggttttggcacacggatgtaaaacccccaatttgtgtgttaaagcgaaatttcacgcttaatgttaatgctgatgcattttattttcatttttaccaacatggtggtactttttatgcgtactatgcggataaaccctccgctactacgtttttgtttagtgtatatattggcgatattttaacacagtattatgtgttacctttcatctgcaacccaacagctggtagcacttttgctccgcgctattgggttacacctttggttaagcgccaatatttgtttaatttcaaccagaagggtgtcattactagtgctgttgattgtgctagtagttataccagtgaaataaaatgtaagacccagagcatgttacctagcactggtgtctatgagttatccggttatacggtccaaccagttggagttgtataccggcgtgttgctaacctcccagcttgtaatatagaggagtggcttactgctaggtcagtccccagccctctcaactgggagcgtaagacttttcagaattgtaattttaatttaagcagcctgttacgttatgttcaggctgagagtttgttttgtaataatatggatgcttccaaagtgtatggcaggtgctttggtagtatttcagttgataagtttgctgtaccccgaagtaggcaagttgatttacagcttggtaactctggatttctgcagactgctaattataagattgatacagctgccacttcgtgtcagctgcattacaccttgcctaagaataatgtcaccataaacaaccataacccctcgtcttggaataggaggtatggctttaatgatgctggcgtctttggcaaaaaccaacatgacgttgtttacgctcagcaatgttttactgtaagatctagttattgcccgtgtgctcaaccggacatagttagcccttgcactactcagactaagcctaagtctgcttttgttaatgtgggtgaccattgtgaaggcttaggtgttttagaagataattgtggcaatgctgatccacataagggttgtatctgtgccaacaattcatttattggatggtcacatgatacctgccttgttaatgatcgctgccaaatttttgctaatatattgttaaatggcattaatagtggtaccacatgttccacagatttgcagttgcctaatactgaagtggttactggcatttgtgtcaaatatgacctctacggtattactggacaaggtgtttttaaagaggttaaggctgactattataatagctggcaaacccttctgtatgatgttaatggtaatttgaatggttttcgtgatcttaccactaacaagacttatacgataaggagctgttatagtggccgtgtttctgctgcatttcataaagatgcacccgaaccggctctaatctatcgtaatataaattgtagctatgtttttagcaataatatttcccgtgaggagaacccacttaattactttgatagttatttgggttgtgttgttaatgctgataaccgcacggatgaggcgcttcctaattgtgatctccgtatgggtgctggcttatgcgttgattattcaaaatcacgcagggctcaccgatcagtttctactggctatcggttaactacatttgagccatacactccgatgttagttaatgatagtgtccaatccgttgatggattatatgagatgcaaataccaaccaattttactattgggcaccatgaggagttcattcaaactagatctccaaaggtgactatagattgtgctgcatttgtctgtggtgataacactgcatgcaggcagcagttggttgagtatggctctttctgtgttaatgttaatgccattcttaatgaggttaataacctcttggataatatgcaactacaagttgctagtgcattaatgcagggtgttactataagctcgagactgccagacggcatctcaggccctatagatgacattaattttagtcctctacttggatgcataggttcaacatgtgctgaagacggcaatggacctagtgcaatccgagggcgttctgctatagaggatttgttatttgacaaggtcaaattatctgatgttggctttgtcgaggcttataataattgcaccggtggtcaagaagttcgtgacctcctttgtgtacaatcttttaatggcatcaaagtattacctcctgtgttgtcagagagtcagatctctggctacacaaccggtgctactgcggcagctatgttcccaccgtggtcagcagctgccggtgtgccatttagtttaagtgttcaatatagaattaatggtttaggtgtcactatgaatgtgcttagtgagaaccaaaagatgattgctagtgcttttaacaatgcgctgggtgctatccaggatgggtttgatgcaaccaattctgctttaggtaagatccagtccgttgttaatgcaaatgctgaagcactcaataacttactaaatcaactttctaacaggtttggtgctattagtgcttctttacaagaaattctaactcggcttgaggctgtagaagcaaaagcccagatagatcgtcttattaatggcaggttaactgcacttaatgcgtatatatccaagcaacttagtgatagtacgcttattaaagttagtgctgctcaggccatagaaaaggtcaatgagtgcgttaagagccaaaacacgcgtattaatttctgtggcaatggtaatcatatattatctcttgtccagaatgcgccttatggcttatattttatacacttcagctatgtgccaatatcctttacaaccgcaaatgtgagtcctggactttgcatttctggtgatagaggattagcacctaaagctggatattttgttcaagatgatggagaatggaagttcacaggcagttcatattactaccctgaacccattacagataaaaacagtgtcattatgagtagttgcgcagtaaactacacaaaggcacctgaagttttcttgaacacttcaatacctaatccacccgactttaaggaggagttagataaatggtttaagaatcagacgtctattgcgcctgatttatctctcgatttcgagaagttaaatgttactttgctggacctgacgtatgagatgaacaggattcaggatgcaattaagaagttaaatgagagctacatcaacctcaaggaagttggcacatatgaaatgtatgtgaaatggccttggtatgtttggttgctaattggattagctggtgtagctgtttgtgtgttgttattctttatatgttgctgcacaggttgtggctcatgttgttttaagaagtgtggaaattgttgtgatgagtatggaggacaccaggacagtattgtgatacataatatttcctctcatgaggattgactatcacagcctctcctggaaagacagaaaatctaaacaatttatagcattctcattgctacctggccccgtaagaggcagtcatagctatggccttgttggtcctaaggctacattggctgctgtctttattggtccatttattgtagcatgtatgctaggcattggcctagtttatttattgcaattgcaagttcaaatttttcatgttaaggataccatacgtgtgactggcaagccagccactgtgtcttatactacaagtacaccagtaacaccgagcgcgacgacgctcgatggtactacgtatactttaattagacccactagctcttatacaagagtttatcttggtactccaagaggttttgattatagtacatttgggcctaagaccctagattatgttactaatctaaacctcatcttaattctggtcgtccatatacttttaaggcattgtccaggcatatgagaccaacagccacatggatttggcatgtgagtgatgcatggttacgccgcacgcgggactttggtgtcattcgcctagaagatttttgttttcaatttaattatagccaaccccgagttggttattgtagagttcctttaaaggcttggtgtagcaaccagggtaaatttgcagcgcagtttaccctaaaaagttgcgaaaaaccaggtcacgaaaaatttattactagcttcacggcctacggcagaactgtccaacaggccgttagcaagttagtagaagaagctgttgattttattctttttagggccacgcagctcgaaagaaatgtttaatttattccttacagacacagtatggtatgtggggcagattatttttatattcgcagtgtgtttgatggtcaccataattgtggttgccttccttgcgtctatcaaactttgtattcaactttgcggtttatgtaatactttggtgctgtccccttctatttatttgtatgataggagtaagcagctttataagtattataatgaagaaatgagactgcccctattagaggtggatgatatctaatccaaacattatgagtagtactactcaggccccagagcccgtctatcaatggacggccgacgaggcagttcaattccttaaggaatggaacttctcgttgggcattatactactctttattactatcatactacagttcggttacacgagccgtagcatgtttatttatgttgtgaaaatgataatcttgtggttaatgtggccactgactattgttttgtgtattttcaattgcgtgtatgcgctaaataatgtgtatcttggattttctatagtgtttactatagtgtccattgtaatctggattatgtattttgttaatagcataaggttgtttatcaggactggtagctggtggagcttcaaccccgaaacaaacaaccttatgtgtatagatatgaaaggtaccgtgtatgttagacccattattgaggattaccatacactaacagccactattattcgtggccacctctacatgcaaggtgttaagctaggcaccggtttctctttgtctgacttgcccgcttatgttacagttgctaaggtgtcacacctttgcacttataagcgcgcattcttagacaaggtagacggtgttagcggttttgctgtttatgtgaagtccaaggtcggaaattaccgactgccctcaaacaaaccgagtggcgcggacaccgcattgttgagaacctaatctaaactttaaggatgtcttttgttcctgggcaagaaaatgccggtggcagaagctcctctgtaaaccgcgctggtaatggaatcctcaagaagaccacttgggctgaccaaaccgagcgtggaccaaataatcaaaatagaggcagaaggaatcagccaaagcagactgcaactactcaacccaactccgggagtgtggttccccattactcctggttttctggcattacccagttccaaaagggaaaggagtttcagtttgcagaaggacaaggagtgcctattgccaatggaatccccgcttcagagcaaaagggatattggtatagacacaaccgccgttcttttaaaacacctgatgggcagcagaagcagctactgcccagatggtatttttactatcttggcacagggccacatgctggagccagttatggagacagcattgaaggagtcttctgggttgcaaacagccaagcggacaccaatacccgctctgatattgtcgaaagggacccaagcagtcatgaggctattcctactaggtttgcgcccggcacggtattgcctcagggcttttatgttgaaggctctggaaggtctgcacctgctagccgatctggttcgcggtcacaatcccgtgggccaaataatcgcgctagaagcagttccaaccagcgccagcctgcctctactgtaaaacctgatatggccgaagaaattgctgctcttgttttggctaagctcggtaaagatgccggccagcccaagcaagtaacgaagcaaagtgccaaagaagtcaggcagaaaattttaaacaagcctcgccaaaagaggactccaaacaagcagtgcccagtgcagcagtgttttggaaagagaggccccaatcagaattttggaggctctgaaatgttaaaacttggaactagtgatccacagttccccattcttgcagagttggctccaacagttggtgccttcttctttggatctaaattagaattggtcaaaaagaattctggtggtgctgatgaacccaccaaagatgtgtatgagctgcaatattcaggtgcagttagatttgatagtactctacctggttttgagactatcatgaaagtgttgaatgagaatttgaatgcctaccagaaggatggtggtgcagatgtggtgagcccaaagccccaaagaaaagggcgtagacaggctctggaaaagaaagatgaagtagataatgtaagcgttgcaaagcccaaaagctctgtgcagcgaaatgtaagtagagaattaaccccagaggatagaagtctgttggctcagatccttgatgatggcgtagtgccagatgggttagaagatgactctaatgtgtaaagagaatgaatcctatgtcggcgctcggtggtaacccctcgcgagaaagtcgggataggacactctctatcagaatggatgtcttgctgtcataacagatagagaaggttgtggcagaccctgtatcaattagttgaaagagattgcaaaatagagaatgtgtgagagaagttagcaaggtcctacgtctaaccataagaacggcgataggcgccccctgggaagagctcacatcagggtactattcctgcaaaaaaaaaaa

SEQ ID NO: 40 - DNA, 31277 bp, Coronavirus
ataagagtgattggcgtccgtacgtaccctttctactctcaaactcttgttagtttaaatctaatctaaactttataaacggcacttcctgtgtgtccatgcccgtgggcttggtcttgtcatagtgctgacatttgtggttccttggtttttgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtagccctgagaggtcagaggaggatgggttttgcccctctgctgcgcaagaaccaaaaactaaaggaaaaactttgattaatcacgtgagggtggattgtagccggcttccagcattggagtgctgtgttcagtctgccataatccgtgatatttttgttgatgaggatcccttgaatgtggaggcctcaactatgatggcattgcagttcggtagtgctgtcttggtcaagccatccaagcgcttgtctattcaggcatgggctaagttgggtgtgctgcctaaaactccagccatggggttgttcaagcgcttctgcctgtgtaacaccagggagtgcgtttgtgacgcccacgtggcttttcaactttttacggtccagcctgatggtgtatgcctgggcaatggccgttttataggctggtttgtgccagtcacagccataccggcgtatgcgaagcagtggttgcaaccctggtccatccttcttcgtaagggtggtaacaaagggtctgtaacatccggccatttccgccgcgctgttaccatgcctgtgtatgactttaatgtggaggatgcttgtgaggaggttcatcttaacccgaagggtaagtactcccgcaaggcgtatgctcttcttaagggctatcgcggtgttaaatccatcctattcttggaccagtatggttgtgactatactgggcgtctcgccaagggtcttgaagactatggcgattgtactttggaagagatgaaggagttgtttcctgtgtggtgtgactccttggataatgaagttgttgtggcctggcatgttgatcgggatcctcgggctgttatgcgcttgcagactcttgctactatacgtagcattggttatgtgggccaaccgaccgaggatttggttgatggagatgtggtagtgcgtgagcctgctcatctcctagcagccaatgccatcgtcaaaaggctcccccgcctggtggagactatgctgtatacggactcttccgttacagaattttgttataaaactaagttgtgtgattgtggttttatcacgcagtttggttatgtggattgctgtggtgatgcctgcgattttcgtgggtgggttcctggcaatatgatggatggctttctttgccccggatgtagtaagagctatatgccctgggaattggaggctcaatcatctggtgtgattccaaaaggtggtgttctatttactcagagcactgacacggtgaatcgtgagtcatttaagctctacggtcatgccgttgtgccttttggttctgctgtgtattggagcccctacccaggtatgtggcttccagttatttggtcttctgttaagtcatatgctgatttgacttacacaggcgttgttggttgtaaggcaattgttcaggagacagatgctatttgccggtccctatatatggactacgttcagcacaagtgtggcaatctcgagcagagagctattcttgggttggatgatgtctaccatagacaattgcttgtaaatagaggtgactatagtctcctccttgaaaatgtagatctttttgttaagcggcgcgctgaatttgcttgtaaattcgccacctgtggagatggtcttgtacctctgctactagatggtttggtgccccgcagttattatttgattaagagtggccaagccttcacctcgatgatggttaattttagccatgaggtgactgacatgtgtatggacatggcattattgttcatgcatgatgttaaagtggccactaagtatgttaagaaggttactggcaaactagccgtgcgctttaaggcgttaggtgtagccgttgtcaggaaaattactgaatggtttgatcttgccgtggacactgctgccagtgctgctggatggctttgctaccagctggtaaatggcttatttgcagtggctaatggtggcataaccttcttaagcgatgttcctgagctggtcaagaattttgttgacaagttcaaggtattcttcaaggttttgatcgactctatgtcggtttctgtcctttctggacttactgttgtcaagactgcctctaatagggtttgtcttgctggctgtaaggtttatgaagttgtgcagaagcgtttgtctgcatatgttatgcctgtgggttgcaacgaggccacttgtttagtgggtgagattgaacctgcagttgttgaagatgatgttgttgatgtggttaaagccccattaacatatcaaggctgttgtaagccacctacttcttttgagaagatttgtgttgtggataaattgtatatggccaagtgtggtgatcaattttaccctgtggttgttgataatgacactattggcgtgttagatcagtgttggaggtttccctgcgcaggcaagaaagtcgagtttaacgacaagcctaaagtcaaggagataccctccacgcgaaagattaagatcaactttgcgttggatgcgacttttgatagtgtcctttcgaaggcgtgttcagagtttgaagttgataaagacgttacattggatgagctgcttgatgttgtgcttgatgcagttgagagtacgctcagcccttgtaaggagcatgatgtgattggcacaaaagtttgtgctttacttaataggttggcagaagattatgtctacctctttgatgagggaggcgaggaagtgattgccccaaagatgtattgttccttttctgctccagatgatgaagactgcgtcgcagcggatgttgtggatgcagatgaaaaccaaggtgacgatgctgacgattctgcagcccttgtcaccgatacccaagaagaggacggtgttgccaaggggcaggttggtgtggctgagtcggatgcccgcctcgatcaagttgaggcatttgatattgaaaaggttgaggatcccatcttgaatgagctctcggctgaacttaatgcgccagcagacaagacctatgaggatgttttggcatttgatgccatttattcagaggcattgtctgcattctatgctgtgccaggtgatgaaacgcactttaaggtgtgtggattctattcgccagctatagagcgtactaattgttggctgcgttctactttgatagtaatgcagagcttacctttagaatttaaagatttggagatgcagaagctctggttgtcgtacaaatccagttataataaggaatttgtcgacaaactagttaagagcgtgcccaagtctatcattcttccacaaggtggctatgtggcagattttgcctacttctttttaagccagtgtagctttaaagcttatgctaactggcgctgtttaaagtgtgacatggacttaaagcttcaaggcttggatgccatgttcttttatggagatgtagtatcccatgtgtgtaagtgtggtactggcatgaccttgttgtctgcagatataccttacactttgcatttcggattgcgagatgataaattttgcgccttttacacgccaagaaaagtctttagggctgcttgtgtggtagatgttaatgattgtcattccatggctgttgtggatggcaagcaaattgatggtaaagttgttaccaaatttaatggtgacaaatatgattttatggtgggtcatgggatggcatttagtatgtcagcctttgagattgcccagttatacggttcatgtataacaccaaatgtttgttttgttaaaggagatgttataaaggttttgcgcagagtgggtgctgaagtcatcgttaaccctgctaatgggcgtatggctcatggtgcgggtgttgcaggtgctatagctaaagctgcgggcaaatcttttattaaggagactgctgatatggtaaagaatcagggcgtttgccaggttggtgagtgctatgaatctaccggcggcaatttatgtaagacggtgcttaacattgtaggaccagatgcccgagggcatggcaagcaatgttactcatttttagagcgtgcttatcagcatattaacaagtgtgacgatgttgttaccactttaatatcagctggtatatttagtgtgcctactgatgtttctctgacttatttaattggtgttgtgactaagaatgttattcttgtcagcaacaacaaagatgattttgatgttatagagaagtgtcaagtgacttccattgctggcactaaagcgctctcacttcaattggctaaaaatttgtgccgagatgtaaagtttgagacaaatgcatgtgattcgctttttagtgactcctgcttcgtctcaagctatgatgtgttgcaggaggttgaattgctgcgacatgacatacagttggatgatgatgcccgtgtctttgtgcaggcccatatggacaacctgcccgctgactggcgtctcgttaataagtttgatagtgttgatggtgttagaaccgttaaatattttgagtgtccgggtgagatttttgtatctagccagggcaagaagtttggttatgttcagaatggttcatttaaagtggcaagtgttagccaaataagggctttacttgctaataaggtggatgtcttgtgcaccgttgatggtgttaacttccgctcgtgctgtgttgcagagggtgaagtttttggcaagacattaggttcagtcttttgtgatggcataaatgtcaccaaggttaggtgtagtgccattcacaagggtaaggtcttctttcagtatagtggtctgtctgcggcagatctcgttgctgttaaggatgcctttggctttgatgaaccacagctgctgaagtactacaatatgctaggcatgtgtaagtggccagtagttgtttgtggcaattattttgcttttaagcagtcaaataataattgctatataaatgtggcatgtttaatgctgcaacatttgagtttaaagtttcataagtggcaatggcaggaggcctggaatgagttccgctctggtaagccactaaggtttgtgtccttggtcttggcaaagggcagctttaaatttaatgaaccttctgattcaactgattttatgcgtgtggtgctgcgcgaagctgatttgagtggtgccacatgcgattttgaatttgtttgtaaatgtggtgtaaagcaagagcagcgcaaaggtgttgacgctgttatgcattttggtacgttggataaaggtgatcttgccaagggttacactatcgcatgcacgtgcggtaataaacttgtgcattgcacccaacttaacgtaccatttttaatttgctccaacaagcctgagggtaagaaattgcctgatgatgttgttgcggctaatatttttactggtggtagtttgggacactacactcatgtgaaatgcaaacccaagtaccagctttatgatgcttgtaatgttagtaaggtctctgaggctaagggtaattttaccgattgcctctaccttaaaaatttaaaacaaactttttcgtccaagttgacgactttttatttagatgatgtaaagtgcgtggagtataatccggatttatcgcagtattactgtgagtctggaaaatattatacaaagcccatcattaaggcccagtttagaacatttgagaaggtagagggtgtctataccaattttaaattggtggggcacagcattgccgaaaaattcaatgctaagctgggatttgattgtaattctccctttacggagtataaaattacagagtggccgacagctactggagatgtggtgttggctagtgatgatttgtatgtgagccgttattcaggtggatgtgttacttttggtaagccggttatctggttgggccacgaggaagcatctctgaaatcgctcacatattttaatagacctagtgtcgtttgtgaaaataaatttaatgtgttgcctgttgatgtcagtgaacccacggataaggggcctgtgccggctgcagtccttgttaccggtgctctgagtggtgctgccactgcgcccggtactgccaaggagcaaaaggtgtgcgcttctgatagtgtggtggatcaggttgtctcggggttcttatcagacctgtctggtgcaaccgtggatgtcaaagaggttaaattgaatggtgttaaaaagcctattaaggtggaagatagtgtggttgttaatgaccccactagcgaaaccaaagttgttaaaagtttgtctattgtcgatgtgtatgatatgttcctgacagggtgtagatatgtggtctggatggctaatgagttgtcccggctagtaaattcacctactgttagggagtatgtgaagtggggtatgactaagattgtaatacccgctaaattggtgttgttaagagatgagaagcaagaatttgtagcgccaaaagtagtcaaggcgaaagttattgcctgctatagtgctgtgaagtggttcttcctctattgttttagttggataaagtttaatactgataataaggttatatacaccacagaagtagcttcaaagcttacttttaatctgtgctgtttggcgtttaagaatgccttacagacttttaattggaacgttgtgtctaggggcttcttcctagtggcaacggtctttttattatggtttaactttttgtatgccaatgttattttgagtgatttctatttgcctaatattggtttctttcctacatttgtgggtcagattgtcgcttgggttaagaccacatttggtatttttaccctctgtgatctttatcaggtgtcagatgttggctatagaagttctttttgtaatggaagtatggtctgcgaactatgcttttcaggttttgacatgttggataactatgatgctataaatgttgttcagcatgttgtggataggcgagtgtcttttgactatattagcctatttaagttagtggtcgagcttgttatcggctactctttgtataccgtgtgtttctatccactgtttggccttattggcatgcagttgctgaccacatggttaccagaattctttatgctggaaactatgcattggagcgcgcgcttctttgtgtttgttgctaatatgcttccagcttttacgttactgcggttttatatcgtggtaacagctatgtataagatcttttgtctttgtagacatgttatgtatggatgtagtaaaccaggttgtttgttttgctataagagaaaccgtagtgtccgtgttaagtgtagcactgttgttggtggtacgctacgctattacgatgtaatggctaatggcggcactggtttctgtgcaaagcatcagtggaactgtcttaattgcagcgcttttggacctggcaacacattcataactcatgaagcagcggcggatctctctaaagaattgaagcgccctgttaatccaacagattctgcttactatttggtcacagaggttaagcaggtaggttgttcaatgcgtctgttctacgagagagatggacagcgcgtttatgatgatgttagtgctagtttgtttgtggatatgaatggtctgctgcattctaaggttaaaggtgtgccagaaacacatgttgtagttgttgagaacgaagctgataaggcaggttttcttaatgctgctgttttctacgcacaatccctttatagaccgatgttgctggtagagaagaaattaataactaccgccaacacgggcttgtctgtgagtcagactatgtttgacctttatgtagactcactgctgggcgtcttggacgttgatcgcaagagtctaacaagttttgtgaatgctgcgcacaattccttaaaggagggtgtgcagcttgaacaagttatggatacctttattggttgcgctcgacgtaagtgtgctatagattcagatgttgagaccaagtctattaccaagtccatcatgtcggcagtaaatgctggtgttgattttacggatgagagttgtaacaacttggtacctacatatgtgaaaagcgacactatcgtcgcagccgatttgggtgttcttattcagaataatgctaagcatgtacaggctaatgttgctaaagctgctaatgtggcttgcatctggtctgtggatgcttttaatcagctatctgctgatctgcagcataggctgagaaaggcatgttcaaaaactggcttgaagattaagcttacttataataagcaggaggcaaatgtccctattttaactacaccgttctctcttaaagggggcgctgtgtttagtaaagttttgcaatggttgtttgttgttaatttgatttgtttcattgtactgtgggctcttatgccgacatatgcagtgcacaaatcagatatgcagttgcctttatatgccagttttaaagttatagataatggtgtgctaagggatgtgaccgttacggatgcatgctttgcaaacaaatttattcaatttgatcaatggtatgagtctacgtttggtcttgtctattaccgtaactctagggcgtgtcctgttgtggttgctgtcatagaccaagatattggctataccttatttaatgttcctactaaagtcttaagatatggatttcatgtgttgcattttataacccatgcatttgctactgatagcgtgcagtgttatacgccacatatgcaaatcccctatgataatttctatgctagtgggtgtgtcttgtcttccctctgtactatgctagcgcatgcagatggcacaccgcatccttattgctatacagagggcattatgcataatgcatctctgtatgactctttggctcctcatgttcgttataacctagctaattcaaatggttatatacgctttcctgaagtggttagtgaaggcattgtgcgtattgtgcgcactcgctccatgacctactgcagggttggcttatgtgaggatgctgaggagggtgtttgttttaactttaatagttcttgggtattgaataacccgtattatagggctatgcctggaactttttgtggtaggaatgcttttgatttaatacaccaagttttaggaggtttagtgcggcccattgacttctttgccctaacggcgagttcagtggctggtgctatcctagcaattattgttgttttagctttttattatttaataaagcttaaacgtgcctttggtgactatactagcgttgtggtcatcaatgtcattgtgtggtgtataaatttcctgatgctatttgtgtttcaggtttatcccactttatcttgtttatatgcttgtttttatttttacacgacgctttatttcccctcggagataagtgttgttatgcatttgcaatggctagtcatgtatggtgctattatgcccttgtggttttgcattatatacgtggcagttgttgtttcaaaccatgcattgtggctgttctcttactgccgtaagcttggtacagaagttcgtagtgatggtacatttgaggagatgtcccttactacttttatgattactaaagaatcctattgtaagttgaaaaattctgtttctgatgttgcttttaacaggtacttgagtctctataacaagtatcggtattttagtggtaaaatggataccgcggcctatagagaggctgcttgttctcaactagcaaaggcgatggaaacatttaaccataataatggtaatgatgttctctatcagccacctacggcctctgttactacatcatttttacagtccggtatagtgaagatggtgtttcccacctctaaggtggaaccttgtgttgttagtgtcacctatggtaacatgacacttaatgggttgtggttggacgataaagtttattgtccaagacatgtcatctgctcctcagctgacatgacagaccctgattattctaatttgctttgtagagtgatatcaagtgatttttgtgttatgtctggtcgtatgagccttactgttatgtcttatcaaatgcagggcagtctacttgttttgactgttacactgcaaaatcctaacacacctaagtactccttcggtgttgttaagcctggtgagacgtttactgttttggctgcatacaacggcaaatctcaaggagccttccatgttactatgcgtagtagctataccataaagggctccttcttgtgtggatcctgcggttctgtaggatatgttttaacgggcgatagtgtacgatttgtctacatgcatcagctagagttgagtactggttgtcacaccggtactgactttagtgggaacttttatggtccctatagagatgctcaagtcgtacaattgcctgttcaagattatacgcagactgttaatgttgtagcttggctttacgctgctattcttaatagatgcaattggtttgtgcaaagtgatagttgttccctggaagagtttaatgtttgggctatgaccaatggttttagttcaattaaagccgaccttgttctagatgctcttgcgtctatgacaggtgttacagttgaacaagtattggctgctattaaccggctgtatcctggcttccagggtaaacaaattttaggtagttgtgtgcttgaggatgagctgacgccaagcgatgtttatcaacaactagctggtgttaagttacagtcaaagcgcacaagagttgttaaaggtacatgttgctggatattggcttcaacattattgttttgtagcattatctcagcatttgtaaaatggactatgtttatgtatgttactacccatatgttgggtgtgacattgtgtgcactttgctttgtgagctttgctatgctgttggttaagcataagcatttgtatttaactatgtttattatgccggttttgtgcacattgttttacacgaactatttagttgtgtataaacagagttttagaggcctagcttatgcatggctttcacactttgtccctgctgtagattatacatacatggatgaagttttatatggtgtcgtgttgctagtagctatggtttttgttaccatgcgcagcataaatcacgatgtcttctctgttatgttcttggttggtagacttgtcagcttggtgtctatgtggtactttggggccaatttagaggaggaggtgctattgttcctcacatcactctttggcacgtatacatggactactatgctgtcattggctactgctaaggtcattgctaaatggttggctgtgaatgtcttgtacttcacagacgtaccgcaagttaaattagttcttttgagctatttgtgtattggttatgtgtgttgttgttattggggcgtcttgtcactccttaatagcatttttaggatgccgttgggtgtctataattataaaatctccgtgcaggagttacgctatatgaatgctaatggcttgcgcccgcccagaaatagttttgaagccctagtgcttaattttaaattgttgggaattggtggtgtgccagtcattgaagtatctcaaattcaatcaagattgactgatgttaaatgtgttaatgttgtgttgcttaactgcctccagcacttgcatattgcatctagttctaagttgtggcagtattgcagtactttgcataatgaaatattagctacatctgatttgagcgtggcctttgataagttggctcagctcctagtagtcttatttgctaatccagcagcagtggatagcaagtgtcttgcaagtattgaagaggtgagcgatgattacgttcgcgacagtactgtcttgcaagccctacagagtgaatttgttaatatggctagcttcgttgagtatgaacttgctaagaagaatttagatgaggccaaggctagcggctctgccaatcaacagcagattaagcaactagagaaggcttgtaatattgctaagtcagcatatgagcgcgacagagctgttgctcgcaagcttgaacgtatggctgatttggctcttacaaatatgtataaagaagctagaattaatgataagaagagtaaggtagtttctgcattgcaaaccatgctttttagtatgattcgtaagctggataaccaagctcttaattctattttagataatgcagttaagggttgtgtacctttgaatgcaataccatcattgacttcaaacactctgactataatagtgccagataagcaggtttttgatcaagttgtggataatgtgtatgtcacctatgctgggaatgtatggcatatacaatctattcaggatgctgatggcgctgttaaacaattgaatgagatagatgttaatataacctggcccctagtcattgctgcaaataggcataatgaagtgtctagtgttgttttgcagaacaatgagttgatgcctcagaagttgagaacgcaggttgtcaatagtggctcagatatgaattgtaatactcctacccagtgttattataatacgactggcatgggtaagattgtgtatgctatacttagtgactgtgatggtcttaagtacactaagatagtaaaagaagatggaaattgtgttgttttggagttggatcctccctgtaaattttcagttcaggatgtgaaggggcttaaaattaagtacctttactttgtgaaggggtgtaatacactggccagaggctgggttgttggcaccttatcctcgacagtgaggttgcaggcaggtacggcaactgagtatgcctccaactctgcaatactgtcgttgtgtgcgttttctgtagatcctaagaaaacgtacctggactatatacaacagggtggagctcccgttactaattgtgttaagatgttatgtgaccatgctggcactggtatggccattactattaagccggaggcaaccactaatcaggattcttatggtggtgcttccgtttgtatatattgccgctcgcgtgttgaacatccagatgttgatggattgtgcaaattacgcggcaagtttgtccaagtgcccttaggtataaaggatcctgtgtcatatgttttgacacatgatgtttgtcaggtctgtggcttttggcgagatggtagctgttcctgtgtaggcacaggctcccagtttcagtcaaaagacacgaactttttaaacgggttcggggtacaagtgtaaatgcccgtcttgtaccctgtgccagtggcttggacactgatgttcaattaagggcatttgatatttgtaatgctaatcgagctggcattggtttgtattataaagtgaattgttgccgttttcagcgcgcagatgaagatggcaacacgttggataagttctttgttattaaaagaaccaatttagaagtgtataataaggagaaagaatgctatgagttgacaaaagaatgtggtgttgtggctgaacacgaattcttcacattcgatgttgagggaagtcgtgtaccacacattgtacgcaaagatctttcaaagtatactatgttagacctttgctatgcattgcggcatttcgatcgcaatgattgttcaactctcaaggaaattctccttacttatgctgagtgtgatgagtcctactttcagaagaaggactggtatgattttgttgagaattctgatataattaatgtgtacaaaaagcttggacctatttttaatagggccttgcttaacactgctaagtttgcggacacattagtggaggcaggcctagtaggtgttttaacacttgataatcaagatttgtatggtcaatggtatgactttggagattttgtcaagacagtgcctggatgtggtgttgccgtggcagattcctattattcttatatgatgccaatgctgactatgtgtcatgcgttggatagtgagttgtttattaatggtacttatagggagtttgaccttgttcagtatgattttactgatttcaagttagagctctttaataagtattttaagtattggagtatgacctatcacccgaacacctgtgagtgcgaggatgacaggtgcattattcattgcgccaattttaatatactatttagtatggttttacctaagacctgttttgggcctcttgttaggcaaatctttgtagatggtgtgcctttcgttgtctcgattggctaccattataaagaattaggtgttgttatgaatatggatgtggatacacatcgttaccgcttgtctcttaaagacttgcttttgtatgcagcagatcctgcccttcatgtggcgtctgctagtgcactgcttgatttgcgcacatgctgttttagcgtagcagctattacaagtggcgtaaaatttcaaacagtcaaacctggaaattttaatcaggatttttatgagtttattttgagtaaaggcctgcttaaagaagggagctccgttgatttgaagcacttcttctttacgcaggatggtaatgctgctattactgattataattattacaagtataatctccccactatggtggatattaagcagttgttgtttgttctagaagttgttaataagtattttgagatctatgatggtgggtgtatacccgcaacacaggtcattgttaataattatgataagagcgctggctatccatttaataaatttggaaaggccagactctattatgaggcattatcatttgaggaacaggatgaagtttatgcgtacactaagcgcaacgtcctgccaacattaactcaaatgaatcttaaatatgctattagtgctaagaatagggctcgcactgttgctggtgtttccattcttagtactatgactggcagaatgtttcatcaaaagtgtttaaagagtatagcagctactcgtggtgttcctgtagttataggcaccacgaaattttatggcggttgggacgatatgttacgccgccttattaaagatgttgatagtcctgtacttatgggttgggactatcctaaatgtgatcgtgctatgccaaacatactgcgcattattagtagtttggtgttagcccgcaaacatgattcgtgctgttcgcatacagatagattctatcgtcttgcgaatgagtgcgcccaagttttgagtgaaattgttatgtgtggtggttgttattatgttaaaccaggtggcactagcagtggggatgcaaccactgcctttgctaattctgtttttaacatttgtcaagctgtctccgccaatgtgtgctcgcttatggcatgcaatggacacaaaattgaagatttgagtatacgcgagttacaaaagcgcctatactctaatgtgtatcgtgcggatcatgttgaccccgcatttgttaatgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggctaaatgttgggtcgaaacagacatcgaaaagggaccacatgaattttgttctcaacacacaatgctagtaaagatggatggtgatgaagtctaccttccatatcctgatccttcgagaatcttaggagcaggctgttttgttgatgatttattaaagactgatagcgttctcttgatagagcgattcgtaagtcttgcaattgatgcttatcctttagtataccatgagaacccagagtatcaaaatgtgttccgggtatatttagaatatataaagaagctgtacaacgatctcggtaatcagatcttggacagctacagtgttattttaagtacttgtgatggtcaaaagtttactgatgagaccttttacaagaacatgtatttaagaagtgcagtgatgcaaagcgtcggtgcctgcgtcgtctgtagctcccaaacatcattacgctgtggcagttgcatacgcaagccattgctgtgttgcaagtgcgcttatgatcatgttatgtctactgatcataaatatgtcctgagtgtgtcaccttatgtgtgtaattcgccgggatgtgatgtaaatgatgttaccaaattgtatttaggtggtatgtcatattattgtgaggaccataagccacagtattcattcaagttagtgatgaatggtatggtttttggtctatataaacaatcttgtactggttcgccctacatagaagattttaataaaatagctagctgtaaatggacagaagtcgatgattatgtgctagctaatgaatgtaccgagcgtctcaaattgtttgccgcagaaacgcaaaaggccactgaagagtcctttaagcaatgttatgcgtcagcaacgatccgtgagatcgtgagcgatcgggagttaattttatcttgggaaattggtaaagtgaggccaccacttaataaaaattatgtttttactggctaccattttacttctaatggtaagacagttttaggtgaatatgtttttgataagagtgagttgactaatggtgtgtattatcgcgccacaaccacttataagttgtctgttggtgatgtttttattttaacatcacatgcagtgtctagtttaagtgctcctacattagtaccgcaggagaattatactagcattcgctttgctagtgtttatagtgtgcctgagacgtttcagaataatgtgccaaattatcagcacattggaatgaagcgttattgtactgtacagggacctcctggtactggaaagtcccatctagccattgggctagctgtttattattgtacagcgcgtgtggtgtataccgctgctagccatgctgcagttgacgcgttgtgtgaaaaggcatataaatttttaaatattaatgactgcacgcgtattgttcctgcaaaggtgcgtgtagattgttatgataaatttaaggtcaatgacaccactcgtaagtatgtgtttactacaataaatgcattacccgagttggtgactgacattattgttgttgatgaagttagtatgcttaccaattatgagttgtctgttattaacagtcgtgttagggctaagcattatgtttatattggagatcctgctcagttgcccgcaccccgtgtgctactgaataagggcactctagaacctagatattttaattctgttaccaagctaatgtgttgcttgggtccagatattttcttgggtacctgttatagatgccctaaggaaattgtggatacagtgtcagccttggtttatcataataagctgaaggctaaaaatgataatagctccatgtgttttaaggtctattataaaggccagactacacatgagagttctagtgctgtcaatatgcagcaaatatatttaattagtaagtttttaaaggcaaaccccagttggagtaacgccgtatttattagtccttataatagtcagaactatgttgctaagagagtcttgggtttacaaacccagacagtagattcagcgcagggttctgaatatgattttgttatttattcacagactgcggaaacagcgcattctgtcaatgtaaatagattcaatgttgctattacacgtgctaagaagggtatcctctgtgtcatgagtagtatgcaattatttgagtctcttaattttagcacactgactctggataagatcaataatccacgattacagtgtactacaaatttgtttaaggattgtagcagaagctatgcaggttatcacccagctcatgcgccttcctttttggcagttgatgataaatataaggtaggtggcgatttagccgtttgccttaatgttgctgattctgctgtcacttattcgcggcttatatcactcatgggattcaagcttgacttgacccttgatggttattgtaagctgtttataactagagatgaagctatcagacgtgttagagcctgggtaggctttgatgcagaaggtgcccatgcgacgcgtgatagcattgggacaaatttcccattacaattaggcttttcgactggaattgattttgttgtcgaggccactggaatgtttgccgagagagatggctacgtctttaaaaaggcagtggcacgagcacctcccggcgaacaatttaaacacctcgtcccacttatgtctagaggacagaaatgggacgtggttcgaattcgaatagtacaaatgctgtcagaccacttagtggatttggcagacagtgttgtacttgtgacgtgggctgccagcttcgagctcacatgtttgcgatatttcgctaaagttggaaaagaagttgtgtgtagtgtctgcaacaagcgtgcgacatgttttaattctaggactgggtactatggatgctggcgacatagttattcctgtgattacctgtataacccactaatagttgatattcaacagtggggatatactgggtctttaactagcaatcatgacctcatttgcagcgtgcataagggtgctcatgtcgcatcttctgatgctatcatgacccgatgcttagctgtccatgattgcttttgcaaatctgttaattggagtttagaataccccattatctcaaatgaggttagtgttaatacctcctgcaggttattgcagcgtgtaatgtttagggctgcgatgctatgcaataggtatgatgtgtgttatgacattggcaaccctaaaggtcttgcctgtgtcaaaggctatgattttaagttttatgatgcctctcctgttgttaagtctgttaaacagtttgtttataagtatgaggcacataaagatcaatttttagatggtttatgtatgttttggaactgcaatgtggataagtatcccgcgaatgcagttgtatgtaggtttgacacgagagtgttaaacaaattaaatctccctggctgtaatggtggtagtctgtatgttaataaacatgcattccacaccagtccctttacgcgggcagccttcgagaatttgaagcctatgcctttcttttattactcagatacgccttgtgtgtatatggagggcatggagtctaagcaggtcgattatgtcccattgagaagcgccacttgcattacaagatgcaatttaggtggcgctgtttgtttaaaacatgctgaggattatcgtgagtaccttgagtcttacaatacggcaaccacagcgggttttaccttttgggtctataagacttttgatttttacaacctttggaatacttttactaggctccaaagtttagaaaatgtagtgtataatttggtaaatgctggacactttgatggacgggcgggtgaactgccttgtgccgttataggtgagaaagtcattgccaagattcaaaatgaggatgtcgtggtttttaaaaataacacgccattccctactaatgtggctgttgaattatttgctaagcgcagtattcgaccacacccagagcttaagctctttagaaatttgaatattgacgtgtgctggagtcacgtcctttgggattatgctaaggatagtgtgttttgcagttcgacgtacaaggtctgcaaatacacagatttacagtgcattgaaagcttgaatgtactttttgatggtcgtgataatggtgctcttgaagcttttaagaagtgccgggatggcgtctacattaacacgacaaaaattaaaagtctgtcgatgattaaaggcccacagcgtgccgatttgaatggcgtagttgtggagaaagttggagattccgatgtggaattttggtttgctatgcgtagagacggtgacgatgttatcttcagccgtacagggagccttgaaccgagccattaccggagcccacaaggtaatccgggtggtaatcgcgtgggtgatctcagcggtaatgaagctctagcacgtggcactatctttactcaaagcagatttttgtcctctttcgcacctcgatcagagatggagaaagactttatggatttagatgaagacgtgttcattgcaaaatatagtttacaggactacgcgtttgaacatgttgtttatggtagtttcaaccagaagatcattggaggtttgcatttgcttattggcttagcccgtaggcagcaaaaatccaatctggttattcaagagttcgtcccgtacgactctagcatccactcgtactttatcactgacgagaacagtggtagcagtaagagtgtgtgcactgttattgatttgttgttagatgattttgtggacattgtaaagtccctgaatctaaattgtgtgagtaaggttgttaatgtgaatgttgattttaaagatttccagtttatgttgtggtgcaatgaggagaaggtcatgactttctatcctcgtttgcaggctgccgctgattggaaacctggttatgttatgcctgtattatacaagtacttggaatcgccgctggaaagagttaatctctggaattatggcaagccgattactttacctacaggatgtttgatgaatgttgctaagtatactcaattatgccaatatttgaatactacaacattagcagtcccggctaatatgcgtgttttacacctcggagccggttctgataaggatgttgcccctggatctgcagttcttaggcagtggttaccagcaggcagcattcttgtagataatgatataaatccatttgtgagtgacagtgttgcctcatattatggaaattgtataaccttacccatagcgtgtcagtgggatttgataatttctgatatgtacgaccctcttactaagaacattggggagtacaacgtgagtaaagatggattctttacttacctttgtcatttaattcgtgacaagttggctctgggtggcagtgtcgccataaaaattacagagttttcttggaacgctgagttatatagtttaatggggaagtttgcgttttggacaatcttttgcaccaacgtaaacgcctcttcaagtgaaggatttttgattggcataaattggttaaataggacccgtaccgagattgacggtaaaaccatgcatgccaattatttgttttggagaaatagtacaatgtggaatggaggggcttacagtctttttgatatgagtaagttccctttgaaggtggctggtacggctgttgtaagcctaaagccagaccaaataaatgatttagtcctctccttgattgagaagggcaagttattagtgcgtgatacacgcaaggaagtatttgttggcgatagccttgtaaatgttaaataaatctatacttgtcatggctgcgatgcaggcctttgctgacaagcctaatcattttataaacttcccattggcccaatttagtggcgttatgggtaagtatttaaagcttcagtcgcaacttgtggaaatgggtttagactgtaaattacagaaagcaccacatgttagtattaccatgctcgatattagagcagatcaatacaaacacgtggaatttgcaatacaagaagtaatagatgatatggcggcatatgagggagatattgtctttgacaaccctcacatgcttggcagatgtcttgttcttgatgttaaaggatttgaagagttgcatgaagatatagttgaaattctccggaaaaggggttgcatagcagatcaatccagacaatggattcctcactgtactgtggcccaatttgaggaagaaaaagaaataaatgagctgcaattctattataaattacccttctacctcaagcataacaacatattaacggatgctaggcttgagcttgtgaagataggttcttccaaaacagatgggttctattgtagtgagctgagcatttggtgtggtgagagactttgttacaagcctccaacacccaaatttagtgatatatttggctattgctgcattgataaaatacgtgttgacttagaaattggtgacctacccgaggatgatgaagaagcgtgggccgagctaagttaccactatcaaagaaacacctacttcttccgctacgtacatgataatagcatttattttcgtaccgtatgcagaatgaagggttgtatgtgttgatttggttttacactagtagtgtaataaacttattattttattgaaacaggcagtatgtgcatggctatggctccccgcactctgcttttgctgattggatgtcagctggtgtttgggttcaatgaacctttaaacaccgtttcacattcaaatgatgattggtttttgtttggtgacagtaggtctgactgcaaccatataagtagcctttctcagcagaattataagtatatggatattaacccagaattgtgtaagtcggggaagatttcttctaaggcgggtaattccctctttagaagttttcatttcaccgatttctacaattatagtggcgaaggttcataaatcatattttatgaaggagttaattttaccccatatgttgggtttaagtgtatgaataatggggataataataggtggatgggtaataaagctcgattttatacccaattgtatcagaagatggctcattatcgtagcctatctataattaatgttacttacacatataatggtaatgctactcccgttgctatgtgtaagcacactgctaatggtgtcacattgaccctaaccctaccttcattggtaaggagacaagtgcacctaattattattatgagagcgaggcaaactttacgttgcatggatgcgatgagtttattgtcccgctctgcgtctttaatggccagtatttatctagtaaactgtattatgatgatagtcagtattattataatattgatacaggcattttatatgggtttaattccaccttgaatattaccactgggttggacttaacctgtatctatctttcattagctcctggtaattataaggccattttaaatgaattattgttaactataccctctaaggctatttgcctgcgtaagcctaaggtgtttacgcttgtgcaagtagttgattctagatggcatagtaataggcaatctgacaatatgactgctattgcgtgtcagctgccatattgttatttccgtaatgccagtaatgattacaatggcatttatgattctcaccatggcgatgctggatttactagcatcttgtctggtttgttatataatgtttcctgtattgcccagcagggtgcatttctttataataatgttagcgcctcttggccagtttttggctacggccattgtccaacggcagctaacattggatatatggcacctgtttgtatgtatgatcctttaccggtcatattacttggtgtcttactgggtatagctgtgttaattattatttttcttattttgtattttatgacggatagcagtgttaggttgcatgaggcctaagtgtttaaatctaatctaaacatgctattcgtgtttttaaccttgttgccctcttctctagggtatattggtgattttagatgtatccaacttgtaaataccgacacctctaatgccagcgctccaagcgttagtacagaggtagttgatgtttccaaagggattggtacttattatgttttagatcgagtctatttaaatgccacactattgcttactggttattaccctgtagatgggtccatgtatagaaacatggctctaacgggaattaataccataagccttaattggtacaaaccaccctttttatcagagtttaatgatggcatatttgctaaggtaaagaaccttaaagcatctttgcccaaagattctatttcatatttccctactataattataggtagtaattttgtcaccacttcctatactgtagtattggaaccgtataatggtataattatggcatccatttgccagtataccatttgtcaactaccgtacacggattgcaaaccgaatacgggcggtaataagttaattggcttttggcacacagagctaaaatcccctgtgtgcattttaaagcgtaattttacgtttaatgttaatgccgaatggctttattttcatttttaccagcagggtggtactttttatgcgtattatgcggatgtttcttctgctactacgtttttgtttagtatgtatattggtgatgtgttaacacaatattttgtgttgccttatatgtgtactctcactacaacaggtgtcttttcaccgcagtattgggttacacctcttgtcaagcgccaatatttatttaattttaatcaaaagggtattattactagtgctgttgattgtgctagtagttataccagcgaaataaagtgtaagacccaaagtatgaatcccaatacgggagtttatgatttatccggttacaccgtccaacctgtaggattagtgtaccggcgtgttagaaatttgcctgattgtaaaattgaggaatggctaactgctaagtctgtaccttctcctctcaattgggagcgcaaaacatttcaaaattgtaacttcgacctgagcagtctattaagatttgttcaggctgagtcactctcatgtagtaatatagatgcttccaaggtttatggtatgtgctttggtagtatatctatagacaagtttgcgatacccaatagacgccgagttgatttgcagctaggcaactctgggtttttgcaatcctttaattacaaaatagatacaagagctacttcgtgtcagctctattatagtcttgcaaaaaataatgtcactgtcaataaccataacccgtcctcttggaacaggcgttatgggttcaatgatgtggctacatttggaactggtaaacatgacgttgcgtatgctgaggcttgttttaccgtgggagcatcatattgcccttgcgcgaaccccagcatagtgtcgccatgtaccactggaaaacctaactttgccaattgccctacaggcacctcgaatcgtgagtgcactgttatgccattggctaataatcaatttaagtgtgattgcacttgtaaccctagtcctctaaccacctatgatcttagatgtctccaagcaagaagcatgcttggcgtaggtgatcattgtgaaggtctaggagttttagaagataaatgtggtggcagcaacacctgcaattgttctgctcatgcctttgttggctgggctaaggatagttgcttggctaatggccgctgtcacatttttagtaatttgatgttaaatggcattaatagtggtactacatgttccatggatttgcaattgcctaatactgaagtggtcactggcgtctgcgtcaaatatgacctctacggtataacaggccaaggtatttttaaggaggttaaggctgactattatcatagttggcaaaacctcttatatgatgttaatggcaacttaatcggatttcgcgattttgttgctaataagagttatactattcgaagttgctatagtgggcgggtctcggctgcatatcatcaagatgcaccagaaccagcgctactatatcgcaatttaaaatgtgactatgtctttaacaacaacatatcccgtgaggagacaccacttaactatttcgatagttatcttggttgtgttgttaatgctgacaactcaactgaagaagctgttgacgcgtgtgatttgcgtatgggtagtgggctttgtgtcaactattcaacgtctcaccgcgctcgcagctctgtcagcacgggttataaattaactacttttgaaccatttacagtccgcattgtcaatgatagtgttgagtctgttgatgggttatatgagctgcaaataccaaccaactttactatagctagccatcaggagttcgttcaaacgaggtctccaaaggttactatagactgtgctgcatttgtctgtggtggccacacagcatgccgtcagcagttggttgagtacggctcattctgtgataatattaatgccattcttggcgaggtaaataacctcatagatactatgcaacttcaagttgcaagtgctttaatccaaggtgtcacgttaagctcacgcttatcggatggcattggtggtcaaatagatgatattaattttagtcctctgcttggttgtttaggttctgactgtggcgaagttaccatggcagctcaaaccggacgatctgctatagaggatgtattatttgacaaagtcaaactctctgatgttggctttgtcgaagcatataacaattgcactggaggccaagaagttagagacctactttgtgtgcaatcttttaatggcatcaaagtgctaccgcctgtgttgtctgagaatcaaatttctggttatacagcgggagctactgtatctgctatgttcccatggtctgcagctgcaggtgtgccattttctttaagtgttcaatatagaattaatggtcttggtgtcactatgaatgttcttagtgaaaatcagaaaatgatagcaagtgcatttaacaacgcgataggtgctatacaggaagggtttgctgcaaccaattctgccttagcaaaaatgcagttcgttgtcaatgcaaatgcggaagcactcaataatttattaaaccagctttccaataggtttggtgcaattagtgcttctttacaagaaattctatctcgcctagatgctcttgaagcgcaggctcagatagaccgtcttattaatggcagattaactgcacttaatgcatatgtctctaagcagctgagtgacatgacccttgttaaggtgagtgcagcccaggctatagagaaagttaatgagtgtgttaaaagccaatcatctaggataaatttctgtggcaatggcaatcatatattgtcattagtccagaatgcgccttatggtttatattttattcatttcagctatgtgcctacttcctttacaacggcaaatgtgagtcctgggctatgcatttctggtgatagaggattagcacctaaagctggatattttgttcaagatgatggagagtggaagttcacaggtagtaattattattaccctgaacccattacagataaaaatagtgtcgtgatgagtagttgcgcagcaaactacacaaaggcacctgaagttttcttgaacacttcaatacctaatctacccgactttaaggaggagttagataaatggtttaaaaatcagacgtctattgcgcctgatttatctctcgatttcgagaaattaaacgttaccctcctggacctgactgatgagatgaacaggattcaggatgcaattaagaagttaaatgagagttacatcaacctcaaggacgttggcacatatgaaatgtatgtgaaatggccttggtatgtgtggttgctaattggattagctggtgtagctgtttgtgtgttgttatttttcatatgttgctgcacgggttgtggctcatgttgtttcaagaagtgtggaaattgttgtgatgagtgtggaggacaccaggacagtattgtgatacataatatttcctctcatgaggattgactatcacagcctctcctggaaagacagaaaatctaaacaatttattgcactttccccgctacttggccccgtaagaggcagccatagctatggccgtgtagggtcctaaagctacattggctgctgtctttatcggtccatttattgtagcatgtatgctaggcattggcctagtttattcattgcaattgcaagtttaaatttttcatgttaatgataccatacgtgtgactggcaagccagccactgtgtcttatactataagtacaccagtaacgccgagtgccacgacgctcgacggtactacgtatactttaattagacccataagctcttatacaagagtttaccttggcaaaaccagagggtttgatactggtacatttggcccaaaggtcttggactatgttactaatctaaacctcatcttaattctggtcgtccatacaccttccgtaagcttggtttatgagaccgacagccacatggacatatggcatgtgagtgatgcttggttacgccgaacgcgagactttggtgtcactcgccttgaagatttttgctttcaatttaattattgccaacctcgaattggttattgtagagttcctttaaaggcttggtgtagcaaccagggtaaatttgcagcgcagtttacccttaaaagttgcgaaaaatcaggccaagaaatatttattactagcttcacggcctacgacaaaactgtcaaaaaggccgttagtaagctagtagaagaagctgttgattttatcatctggagagccacgcagctcgaaagatatgtttaatttattccttacagatacagtatggtatgtggggcagattatttttatagtcgcagtgtgtttgatggtcaccataatagtggttgccttccttgcgtctatcaaactttgtattcaactttgcggtttgtgtaatactttgttgctgtctccttctatttgtgtgtataataggagtaagcagctttataagtattataatgaagaagtgagaccgcccccgttagaggtggatgatataataatccaaacattatgagtagtactactcaggccccagagcccgtctatcaatggacggccgacgaggcagttcaattccttaaggaatggaacttctcgttgggcattatactactctttattactatcatactacagttcggttacacgagccgtagcatgtttatttatgttgtgaaaatgataatcttgtggttaatgtggccactgactattgttttgtgtattttcaattgcgtgtatgcgctaaataatgtgtatcttggattttctatagtgtttactatagtgtccattgtaatctggattatgtattttgttaatagcataaggttgtttatcaggactggtagctggtggagcttcaaccccgaaacaaacaaccttatgtgtatagatatgaaaggtaccgtgtatgttagacccattattgaggattaccatacactaacagccactattattcgtggccacctctacatgcaaggtgttaagctaggcaccggtttctctttgtctgacttgcccgcttatgttacagttgctaaggtgtcacacctttgcacttataagcgcgcattcttagacaaggtagacggtgttagcggttttgctgtttatgtgaagtccaaggtcggaaattaccgactgccctcaaacaaaccgagtggcgcggacaccgcattgttgagaatctaatctaaactttaaggatgtcttttgttcctgggcaagaaaatgccggtagcagaagctcctctggaaaccgcgctggtaatggcatcctcaagaagaccacttgggctgaccaaaccgagcgtggaaatagaggcagaaggaaccatcccaagcagactgcaactactcagcccaatgccgggagtgtggttccccattactcttggttttcgggcatcacccagtttcaaaagggaaaggagttccagtttgcacaaggacagggagtgcctattgccagtggaatccccgcttcagagcaaaagggatattggtatagacacaaccgacgttcttttaaaacacctgatggccagcacaagcagctactgcccagatggtatttttactatcttggaacagggccccatgctggcgcagagtatggcgacgatatcgaaggagttgtctgggtcgcaagccaacaggccgacactaagaccactgccgatgttgttgaaagggacccaagcagtcatgaggctattcctactaggtttgcgcccggcacggtattgcctcagggcttttatgtagaaggctcgggaaggtctgcacctgctagtcgatctggttcgcggtcacaatcccgtgggccaaataatcgcgctagaagcagttccaaccagcgccagcctgcctctgctgtaaaacctgacatggccgaagaaattgctgctcttgttttggctaagcttggtaaagatgccggccagcccaagcaggtaactaagcaaagcgccaaagaagtcaggcagaaaattttaactaagcctcgtcaaaagaggactccaaacaagcagtgcccagtgcagcagtgttttgggaagagaggccctaatcagaactttggaggctctgaaatgttaaaacttggaactagtgatccgcagttccccattcttgcagagttggctccaacacctagtgccttcttctttggatctaaattagaattggtcaaaaagaactctggtggtgctgatgaacccaccaaagatgtttatgaattgcagtattcaggtgcaattagatttgatagtactctacccggttttgagactatcatgaaagtgttgactgagaatttgaatgcctaccaggaccaagctggtagtgtagatctagtgagcccaaagcctccaagaagaggtcgtagacaggctcaagaaaagaaagatgaagtagataatgtaagcgttgcaaagctcaaaagcttggtgcagcgaaatgtaagtagagaattaacccccgaggatcgtagcctgctggctcagatcctagacgatggcgttgtgccagatgggttggaagatgactctaatgtgtaaagagaatgaatcctatgtcggcgctcggtggtaacccctcgcgagaaagtcgggataggacactctctatcagaatggatgtcttgctgtcataacagatagagaaggttgtggcagaccctgtatcaattagttgaaagagattgcaaaatagagaatgtgtgagagaagttagcaaggtcctacgtctaaccataagaacggcgataggcgccccctgggaagagctcacatcagggtactattcctgcaatgcactagtaaatgaatgaagttgatcatggccaattggaagaatcacaaaaaaaaaaaaaa

SEQ ID NO: 41 - DNA, 31112 bp, Coronavirus
ataagagtgattggcgtccgtacgtaccctttctactctcaaactcttgttagtttaaatctaatctaaactttataaacggcacttcctgtgtgtccatgcccgtgggcttggtcttgtcatagtgctgacatttgtggttccttggtttttgttctctgccagtgacgtgtccattcggcgccagcagcccacccataggttgcataatggcaaagatgggcaaatacggtctcggcttcaaatgggccccagaatttccatggatgcttccgaacgcatcggagaagttgggtagccctgagaggtcagaggaggatgggttttgcccctctgctgcgcaagaaccaaaaactaaaggaaaaactttgattaatcacgtgagggtggattgtagccggcttccagcattggagtgctgtgttcagtctgccataatccgtgatatttttgttgatgaggatcccttgaatgtggaggcctcaactatgatggcattgcagttcggtagtgctgtcttggtcaagccatccaagcgcttgtctattcaggcatgggctaagttgggtgtgctgcctaaaactccagccatggggttgttcaagcgcttctgcctgtgtaacaccagggagtgcgtttgtgacgcccacgtggcttttcaactttttacggtccagcctgatggtgtatgcctgggcaatggccgttttataggctggtttgtgccagtcacagccataccggcgtatgcgaagcagtggttgcaaccctggtccatccttcttcgtaagggtggtaacaaaggttctgtaacatccggccatttccgccgcgctgttaccatgcctgtgtatgactttaatgtggaggatgcttgtgaggaggttcatcttaacccgaagggtaagtactcccgcaaggcgtatgctcttcttaagggctatcgcggtgttaaatccatcctattcttggaccagtatggttgtgactatactgggcgtctcgccaagggtcttgaagactatggcgattgtactttggaagagatgaaggagttgtttcctgtgtggtgtgactccttggataatgaagttgttgtggcctggcatgttgatcgggatcctcgggctgttatgcgcttgcagactcttgctactgtacgttgcattggttatgtgggccaaccgaccgaggatttggttgatggagatgtggtagtgcgtgagcctgctcatctcctagcagccaatgccatcgtcaaaaggctcccccgcctggtggagactatgctgtatacggactcttccgttacagaattttgttataaaactaagttgtgtgattgtggttttatcacgcagtttggttatgtggattgctgtggtgatgcctgcgattttcgtgggtgggttcctggcaatatgatggatggctttctttgccccggatgtagtaagagctatatgccctgggaattggaggctcaatcatctggtgtgattccaaaaggtggtgttctatttactcagagcactgacacggtgaatcgtgagtcatttaagctctacggtcatgccgttgtgccttttggttctgctgtgtattggagcccctacccaggtatgtggcttccagttatttggtcttctgttaagtcatatgctgatttgacttacacaggcgttgttggttgtaaggcaattgttcaggagacagatgctatttgccggtccctatatatggactacgttcagcacaagtgtggcaatctcgagcagagagctattcttgggttggatgatgtctaccatagacaattgcttgtaaatagaggtgactatagtctcctccttgaaaatgtagatctttttgttaagcggcgcgctgaatttgcttgtaaattcgccacctgtggagatggtcttgtacctctgctactagatggtttggtgccccgcagttattatttgattaagagtggccaagccttcacctcgatgatggttaattttagccatgaggtgactgacatgtgtatggacatggcattattgttcatgcatgatgttaaagtggccactaagtatgttaagaaggttactggcaaactagccgtgcgctttaaggcgttaggtgtagccgttgtcaggaaaattactgaatggtttgatcttgccgtggacactgctgccagtgctgctggatggctttgctaccagctggtaaatggcttatttgcagtggctaatggtggcataaccttcttaagcgatgttcctgagctggtcaagaattttgttgacaagttcaaggtattcttcaaggttttgatcgactctatgtcggtttctgtcctttctggacttactgttgtcaagactgcctctaatagggtttgtcttgctggctgtaaggtttatgaagttgtgcagaagcgtttgtctgcatatgttatgcctgtgggttgcaacgaggccacttgtttagtgggtgagattgaacctgcagttgttgaagatgatgttgttgatgtggttaaagccccattaacatatcaaggctgttgtaagccacctacttcttttgagaagatttgtgttgtggataaattgtatatggccaagtgtggtgatcaattttaccctgtggttgttgataatgacactattggcgtgttagatcagtgttggaggtttccctgcgcaggcaagaaagtcgagtttaacgacaagcctaaagtcaaggagataccctccacgcgaaagattaagttcaactttgcgttggatgcgacttttgatagtgtcctttcgaaggcgtgttctgagtttgaagttgataaagacgttacattggatgagctgcttgatgttgtgcttgatgcagttgagagtacgctcagcccttgtaaggagcatgatgtgattggcacaaaagtttgtgctttacttaataggttggcagaagattatgtctacctctttgatgagggaggcgaggaagtgattgccccaaagatgtattgttccttttctgctccagatgatgaagactgcgtcgcagcggatgttgtggatgcagatgaaaaccaaggtgacgatgctgacgattctgcagcccttgtcaccgatacccaagaagaggacggtgttgccaaggggcaggttggtgtggctgagtcggatgcccgcctcgatcaagttgaggcatttgatattgaaaaggttgaggatcccatcttgaatgagctctcggctgaacttaatgcgccagcagacaagacctatgaggatgttttggcatttgatgccatttattcagaggcattgtctgcattctatgctgtgccaggtgatgaaacgcactttaaggtgtgtggattctattcgccagctatagagcgtactaattgttggctgcgttctactttgatagtaatgcagagcttacctttagaatttaaagatttggagatgcagaagctctggttgtcgtacaaatccagttataataaggaatttgtcgacaaactagttaagagcgtgcccaagtctatcattcttccacaaggtggctatgtggcagattttgcctacttctttttaagccagtgtagctttaaagcttatgctaactggcgctgtttaaagtgtgacatggacttaaagcttcaaggcttggatgccatgttcttttatggagatgtagtatcccatgtgtgtaagtgtggtactggcatgaccttgttgtctgcagatataccttacactttgcatttcggattgcgagatgataagttttgcgctttttacacgccaagaaaggtctttagggctgcttgtgcggtagatgttaatgattgtcactctatggctgtagtagagggcaagcaaattgatggtaaagtggttaccaaatttattggtgacaaatttgattttatggtgggttacgggatgacatttagtatgtctccttttgaactcgcccagttatatggttcatgtataacaccaaatgtttgttttgttaaaggagatgttataaaggttgttcgcttagttaatgctgaagtcattgttaaccctgctaatgggcgtatggctcatggtgcaggtgttgcaggtgctatagctgaaaaggcgggcagtgcttttattaaagaaacctccgatatggtgaaggctcagggcgtttgccaggttggtgaatgctatgaatctgccggtggtaagttatgtaaaaaggtgcttaacattgtaggaccagatgcccgagggcatggcaagcaatgttactcatttttagagcgtgcttatcagcatattaacaagtgtgacgatgttgttaccactttaatatcagctggtatatttagtgtgcctactgatgtttctctgacttatttaattggtgttgtgactaagaatgttattcttgtcagcaacaacaaagatgattttgatgttatagagaagtgtcaagtgacttccattgctggcactaaagcgctctcacttcaattggctaaaaatttgtgccgagatgtaaagtttgagacaaatgcatgtgattcgctttttagtgactcctgcttcgtctcaagctatgatgtgttgcaggaggttgaattgctgcgacatgacatacagttggatgatgatgcccgtgtctttgtgcaggcccatatggacaacctgcccgctgactggcgtctcgttaataagtttgatagtgttgatggtgttagaaccgttaaatattttgagtgtccgggtgagatttttgtatctagccagggcaagaagtttggttatgttcagaatggttcatttaaagtggcaagtgttagccaaataagggctttacttgctaataaggtggatgtcttgtgcaccgttgatggtgttaacttccgctcgtgctgtgttgcagagggtgaagtttttggcaagacattaggttcagtcttttgtgatggcataaatgtcaccaaggttaggtgtagtgccattcacaagggtaaggtcttctttcagtatagtggtctgtctgcggcagatctcgttgctgttaaggatgcctttggctttgatgaaccacagctgctgaagtactacaatatgctaggcatgtgtaagtggccagtagttgtttgtggcaattattttgcttttaagcagtcaaataataattgctatataaatgtggcatgtttaatgctgcaacatttgagtttaaagtttcataagtggcaatggcaggaggcctggaatgagttccgctctggtaagccactaaggtttgtgtccttggtcttggcaaagggcagctttaaatttaatgaaccttctgattcaactgattttatgcgtgtggtgctgcgcgaagctgatttgagtggtgccacatgcgattttgaatttgtttgtaaatgtggtgtaaagcaagagcagcgcaaaggtgttgacgctgttatgcattttggtacgttggataaaggtgatcttgccaagggttacactatcgcatgcacgtgcggtaataaacttgtgcattgcacccaacttaacgtaccatttttaatttgctccaacaagcctgagggtaagaaattgcctgatgatgttgttgcggctaatatttttactggtggtagtttgggacactacactcatgtgaaatgcaaacccaagtaccagctttatgatgcttgtaatgttagtaaggtctctgaggctaagggtaattttaccgattgcctctaccttaaaaatttaaaacaaactttttcgtccaagttgacgactttttatttagatgatgtaaagtgcgtggagtataatccggatttatcgcagtattactgtgagtctggaaaatattatacaaagcccatcattaaggcccagtttagaacatttgagaaggtagagggtgtctataccaattttaaattggtggggcacagcattgccgaaaaattcaatgctaagctgggatttgattgtaattctccctttacggagtataaaattacagagtggccgacagctactggagatgtggtgttggctagtgatgatttgtatgtgagccgttattcaggtggatgtgttacttttggtaagccggttatctggttgggccacgaggaagcatctctgaaatcgctcacatattttaatagacctagtgtcgtttgtgaaaataaatttaatgtgttgcctgttgatgtcagtgaacccacggataaggggcctgtgccggctgcagtccttgttaccggtgctctgagtggtgctgccactgcgcccggtactgccaaggagcaaaaggtgtgcgcttctgatagtgtggtggatcaggttgtctcggggttcttatcagacctgtctggtgcaaccgtggatgtcaaagaggttaaattgaatggtgttaaaaagcctattaaggtggaagatagtgtggttgttaatgaccccactagcgaaaccaaagttgttaaaagtttgtctattgtcgatgtgtatgatatgttcctgacagggtgtagatatgtggtctggatggctaatgagttgtcccggctagtaaattcacctactgttagggagtatgtgaagtggggtatgactaagattgtaatacccgctaaattggtgttgttaagagatgagaagcaagaatttgtagcgccaaaagtagtcaaggcgaaagttattgcctgctatagtgctgtgaagtggttcttcctctattgttttagttggataaagtttaatactgataataaggttatatacaccacagaagtagcttcaaagcttacttttaatttgtgctgtttggcgtttaagaatgccttacagacttttaattggaacgttgtgtctaggggctttttcctagtggcaacggtctttttattatggtttaactttttgtatgccaatgttattttgagtgatttctatttgcctaatattggtttctttcctacatttgtgggtcagattgtcgcttgggttaagaccacatttggtatttttaccctctgtgatctttatcaggtgtcagatgttggctatagaagttctttttgtaatggaagtatggtctgcgaactatgcttttcaggttttgacatgttggataactatgatgctataaatgttgttcagcatgttgtggataggcgagtgtcttttgactatattagcctatttaagttagtggtcgagcttgttatcggctactctttgtataccgtgtgtttctatccactgtttggccttattggcatgcagttgctgaccacatggttaccagaattctttatgctggaaactatgcattggagcgcgcgcttctttgtgtttgttgctaatatgcttccagcttttacgttactgcggttttatatcgtggtaacagctatgtataagatcttttgtctttgtagacatgttatgtatggatgtagtagaccaggttgtttgttttgctataagagaaaccgtagtgtccgtgttaagtgtagcactgttgttggtggtacgctacgctattacgatgtaatggctaatggcggcactggtttctgtgcaaagcatcagtggaactgtcttaattgcagcgcttttggacctggcaacacattcataactcatgaagcagcggcggatctctctaaagaattgaagcgccctgttaatccaacagattctgcttactatttggtcacagaggttaagcaggtaggttgttcaatgcgtctgttctacgagagagatggacagcgcgtttatgatgatgttagtgctagtttgtttgtggatatgaatggtctgctgcattctaaggttaaaggtgtgccagaaacacatgttgtagttgttgagaacgaagctgataaggcaggttttcttaatgctgctgttttttacgcacaatccctttatagaccgatgttgctggtagagaagaaattaataactaccgccaacacgggcttgtctgtgagtcagactatgtttgacctttatgtagactcactgctgggcgtcttggacgttgatcgcaagagtctaacaagttttgtgaatgctgcgcacaattccttaaaggagggtgtgcagcttgaacaagttatggatacctttattggttgcgctcgacgtaagtgtgctatagattcagatgttgagaccaagtctattaccaagtccatcatgtcggcagtaaatgctggtgttgattttacggatgagagttgtaacaacttggtacctacatatgtgaaaagcgacactatcgtcgcagccgatttgggtgttcttattcagaataatgctaagcatgtacaggctaatgttgctaaagctgctaatgtggcttgcatctggtctgtggatgcttttaatcagctatctgctgatctgcagcataggctgagaaaggcatgttcaaaaactggcttgaagattaagcttacttataataagcaggaggcaaatgtccctattttaactacaccgttctctcttaaagggggcgctgtgtttagtaaagttttgcaatggttgtttgttgttaatttgatttgtttcattgtactgtgggctcttatgccgacatatgcagtgcacaaatcagatatgcagttgcctttatatgccagttttaaagttatagataatggtgtgctaagggatgtgaccgttacggatgcatgctttgcaaacaaatttattcaatttgatcaatggtatgagtctacgtttggtcttgtctattaccgtaactctagggcgtgtcctgttgtggttgctgtcatagaccaagatattggctataccttatttaatgttcctactaaagtcttaagatatggatttcatgtgttgcattttataacccatgcatttgctactgatagcgtgcagtgttatacgccacatatgcaaatcccctatgataatttctatgctagtgggtgtgtcttgtcttccctctgtactatgctagcgcatgcagatggcacaccgcatccttattgctatacagagggcattatgcataatgcatctctgtatgactctttggctcctcatgttcgttataacctagctaattcaaatggttatatacgctttcctgaagtggttagtgaaggcattgtgcgtattgtgcgcactcgctccatgacctactgcagggttggcttatgtgaggatgctgaggagggtgtttgttttaactttaatagttcttgggtattgaataacccgtattatagggctatgcctggaactttttgtggtaggaatgcttttgatttaatacaccaagttttaggaggtttagtgcggcccattgacttctttgccctaacggcgagttcagtggctggtgctatcctagcaattattgttgttttagctttttattatttaataaagcttaaacgtgcctttggtgactatactagcgttgtggtcatcaatgtcattgtgtggtgtataaatttcctgatgctatttgtgtttcaggtttatcccactttatcttgtttatatgcttgtttttatttttacacgacgctttatttcccctcggagataagtgttgttatgcatttgcaatggctagtcatgtatggtgctattatgcccttgtggttttgcattatatacgtggcagttgttgtttcaaaccatgcattgtggctgttctcttactgccgtaagcttggtacagaagttcgtagtgatggtacatttgaggagatgtcccttactacttttatgattactaaagaatcctattgtaagttgaaaaattctgtttctgatgttgcttttaacaggtacttgagtctctataacaagtatcggtattttagtggtaaaatggataccgcggcctatagagaggctgcttgttctcaactagcaaaggcgatggaaacatttaaccataataatggtaatgatgttctctatcagccacctacggcctctgttactacatcatttttacagtccggtatagtgaagatggtgtttcccacctctaaggtggaaccttgtgttgttagtgtcacctatggtaacatgacacttaatgggttgtggttggacgataaagtttattgtccaagacatgtcatttgctcctcagctgacatgacagaccctgattattctaatttgctttgtagagtgatatcaagtgatttttgtgttatgtctggtcgtatgagccttactgttatgtcttatcaaatgcagggcagtctacttgttttgactgttacactgcaaaatcctaacacacctaagtactccttcggtgttgttaagcctggtgagacgtttactgttttggctgcatacaacggcaaatctcaaggagccttccatgttactatgcgtagtagctataccataaagggctccttcttgtgtggatcctgcggttctgtaggatatgttttaacgggcgatagtgtacgatttgtctacatgcatcagctagagttgagtactggttgtcacaccggtactgactttagtgggaacttttatggtccctatagagatgctcaagtcgtacaattgcctgttcaagattatacgcagactgttaatgttgtagcttggctttacgctgctattcttaatagatgcaattggtttgtgcaaagtgatagttgttccctggaagagtttaatgtttgggctatgaccaatggttttagttcaattaaagccgaccttgttctagatgctcttgcgtctatgacaggtgttacagttgaacagatcttggctgctattaagcggctgtatcctggctttcagggtaaacaaattttaggtagttgtgtgcttgaggatgagctgacgccaagcgatgtttatcaacaactagctggtgttaagttacagtcaaagcgcacaagagttgttaaaggtacatgttgctggatattggcttcaacattattgttttgtagcattatctcagcatttgtaaaatggactatgtttatgtatgttactacccatatgttgggtgttacattgtgtgcactttgctttgtgagctttgctatgctgttggttaagcataagcatttgtatttaactatgtttattatgccggttttgtgcacattgttttacacgaactatttagttgtgtataaacagagttttagaggcctagcttatgcatggctttcacactttgtccctgctgtagattatacatacatggatgaagttttatatggtgttgtgttgctagtagctatggtttttgttaccatgcgcagcataaatcacgatgtcttctctgttatgttcttggttggtagacttgtcagcttggtgtctatgtggtactttggggccaatttagaggaggaggtgctattgttcctcacatcactctttggcacgtatacatggactactatgctgtcattggctactgctaaggtcattgctaaatggttggctgtgaatgtcttgtacttcacagacgtaccgcaagttaaattagttcttttgagctatttgtgtattggttatgtgtgttgttgttattggggcgtcttgtcactccttaatagcatttttaggatgccgttgggtgtctataattataaaatctccgtgcaggagttacgctatatgaatgctaatggcttgcgcccgcccagaaatagttttgaagccctagtgcttaattttaaattgttgggaattggtggtgtgccagtcattgaagtatctcaaattcaatcaagattgactgatgttaaatgtgttaatgttgtgttgcttaactgcctccagcacttgcatattgcatctagttctaagttgtggcagtattgcagtactttgcataatgaaatattagctacatctgatttgagcgtggcctttgataagttggctcagctcctagtagtcttatttgctaatccagcagcagtggatagcaagtgtcttgcaagtattgaagaggtgagcgatgattacgttcgcgacagtactgtcttgcaagccctacagagtgaatttgttaatatggctagcttcgttgagtatgaacttgctaagaagaatttagatgaggccaaggctagcggctctgccaatcaacagcagattaagcaactagagaaggcttgtaatattgctaagtcagcatatgagcgcgacagagctgttgctcgcaagcttgaacgtatggctgatttggctcttacaaatatgtataaagaagctagaattaatgataagaagagtaaggtagtttctgcattgcaaaccatgctttttagtatgattcgtaagctggataaccaagctcttaattctattttagataatgcagttaagggttgtgtacctttgaatgcaataccatcattgacttcaaacactctgactataatagtgccagataagcaggtttttgatcaagttgtggataatgtgtatgtcacctatgctgggaatgtatggcatatacaatctattcaggatgctgatggcgctgttaaacaattgaatgagatagatgttaatataacctggcccctagtcattgctgcaaataggcataatgaagtgtctagtgttgttttgcagaacaatgagttgatgcctcagaagttgagaacgcaggttgtcaatagtggctcagatatgaattgtaatactcctacccagtgttattataatacgactggcatgggtaagattgtgtatgctatacttagtgactgtgatggtcttaagtacactaagatagtaaaagaagatggaaattgtgttgttttggagttggatcctccctgtaaattttcagttcaggatgtgaaggggcttaaaattaagtacctttactttgtgaaggggtgtaatacactggccagaggctgggttgttggcaccttatcctcgacagtgaggttgcaggcaggtacggcaactgagtatgcctccaactctgcaatactgtcgttgtgtgcgttttctgtagatcctaagaaaacgtacctggactatatacaacagggtggagctcccgttactaattgtgttaagatgttatgtgaccatgctggcactggtatggccattactattaagccggaggcaaccactaatcaggattcttatggtggtgcttccgtttgtatatattgccgctcgcgtgttgaacatccagatgttgatggattgtgcaaattacgcggcaagtttgtccaagtgcccttaggtataaaggatcctgtgtcatatgttttgacacatgatgtttgtcaggtctgtggcttttggcgagatggtagctgttcctgtgtaggcacaggctcccagtttcagtcaaaagacacgaactttttaaacgggttcggggtacaagtgtaaatgcccgtcttgtaccctgtgccagtggcttggacactgatgttcaattaagggcatttgatatttgtaatgctaatcgagctggcattggtttgtattataaagtgaattgttgccgttttcagcgcgcagatgaagatggcaacacgttggataagttctttgttattaaaagaaccaatttagaagtgtataataaggagaaagaatgctatgagttgacaaaagaatgtggtgttgtggctgaacacgaattcttcacattcgatgttgagggaagtcgtgtaccacacattgtacgcaaagatctttcaaagtatactatgttagacctttgctatgcattgcggcatttcgatcgcaatgattgttcaactctcaaggaaattctccttacttatgctgagtgtgatatcctactttcagaagaaggatggtatgattttgttgagaattctgatataattaatgtgtacaaaaagcttggacctatttttaatagggccttgcttaacactgctaagtttgcggacacattagtggaggcaggcctagtaggtgttttaacacttgataatcaagatttgtatggtcaatggtatgactttggagattttgtcaagacagtgcctggatgtggtgttgccgtggcagattcctattattcttatatgatgccaatgctgactatgtgtcatgcgttggatagtgagttgtttattaatggtacttatagggagtttgaccttgttcagtatgattttactgatttcaagttagagctctttaataagtattttaagtattggagtatgacctatcacccgaacacctgtgagtgcgaggatgacaggtgcattattcattgcgccaattttaatatactatttagtatggttttacctaagacctgttttgggcctcttgttaggcaaatctttgtagatggtgtgcctttcgttgtctcgattggctaccattataaagaattaggtgttgttatgaatatggatgtggatacacatcgttaccgcttgtctcttaaagacttgcttttgtatgcagcagatcctgcccttcatgtggcgtctgctagtgcactgcttgatttgcgcacatgctgttttagcgtagcagctattacaagtggcgtaaaatttcaaacagtcaaacctggaaattttaatcaggatttttatgagtttattttgagtaaaggcctgcttaaagaagggagctccgttgatttgaagcacttcttctttacgcaggatggtaatgctgctattactgattataattattacaagtataatctccccactatggtggatattaagcagttgttgtttgttctagaagttgttaataagtattttgagatctatgatggtgggtgtatacccgcaacacaggtcattgttaataattatgataagagcgctggctatccatttaataaatttggaaaggccagactctattatgaggcattatcatttgaggaacaggatgaagtttatgcgtacactaagcgcaacgtcctgccaacattaactcaaatgaatcttaaatatgctattagtgctaagaatagggctcgcactgttgctggtgtttccattcttagtactatgactggcagaatgtttcatcaaaagtgtttaaagagtatagcagctactcgtggtgttcctgtagttataggcaccacaaaattttatggcggttgggacgatatgttacgccgccttattaaagatgttgatagtcctgtacttatgggttgggactatcctaaatgtgatcgtgctatgccaaacatactgcgcattattagtagtttggtgttagcccgcaaacatgattcgtgctgttcgcatacagatagattctatcgtcttgcgaatgagtgcgcccaagttttgagtgaaattgttatgtgtggtggttgttattatgttaaaccaggtggcactagcagtggggatgcaaccactgcctttgctaattctgtttttaacatttgtcaagctgtctccgccaatgtgtgctcgcttatggcatgcaatggacacaaaattgaagatttgagtatacgcgagttacaaaagcgcctatactctaatgtgtatcgtgcggatcatgttgaccccgcatttgttaatgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggctaaatgttgggtcgaaacagacatcgaaaagggaccacatgaattttgttctcaacacacaatgctagtaaagatggatggtgatgaagtctaccttccatatcctgatccttcgagaatcttaggagcaggctgttttgttgatgatttattaaagactgatagcgttctcttgatagagcgattcgtaagtcttgcaattgatgcttatcctttagtataccatgagaacccagagtatcaaaatgtgttccgggtatatttagaatatataaagaagctgtacaacgatctcggtaatcagatcttggacagctacagtgttattttaagtacttgtgatggtcaaaagtttactgatgagaccttttacaagaacatgtatttaagaagtgcagtgatgcaaagcgtcggtgcctgcgtcgtctgtagctcccaaacatcattacgctgtggcagttgcatacgcaagccattgctgtgttgcaagtgcgcttatgatcatgttatgtctactgatcataaatatgtcctgagtgtgtcaccttatgtgtgtaattcgccgggatgtgatgtaaatgatgttaccaaattgtatttaggtggtatgtcatattattgtgaggaccataagccacagtattcattcaagttagtgatgaatggtatggtttttggtctatataaacaatcttgtactggttcgccctacatagaagattttaataaaatagctagctgtaaatggacagaagtcgatgattatgtgctagctaatgaatgtaccgagcgtctcaaattgtttgccgcagaaacgcaaaaggccactgaagagtcctttaagcaatgttatgcgtcagcaacgatccgtgagatcgtgagcgatcgggagttaattttatcttgggaaattggtaaagtgaggccaccacttaataaaaattatgtttttactggctaccattttacttctaatggtaagacagttttaggtgaatatgtttttgataagagtgagttgactaatggtgtgtattatcgcgccacaaccacttataagttgtctgttggtgatgtttttattttaacatcacatgcagtgtctagtttaagtgctcctacattagtaccgcaggagaattatactagcattcgctttgctagtgtttatagtgtgcctgagacgtttcagaataatgtgccaaattatcagcacattggaatgaagcgttattgtactgtacagggacctcctggtactggaaagtcccatctagccattgggctagctgtttattattgtacagcgcgtgtggtgtataccgctgctagccatgctgcagttgacgcgttgtgtgaaaaggcatataaatttttaaatattaatgactgcacgcgtattgttcctgcaaaggtgcgtgtagattgttatgataaatttaaggtcaatgacaccactcgtaagtatgtgtttactacaataaatgcattacccgagttggtgactgacattattgttgttgatgaagttagtatgcttaccaattatgagttgtctgttattaacagtcgtgttagggctaagcattatgtttatattggagaccctgctcagttgcccgcaccccgtgtgctactgaataagggcactctagaacctagatattttaattctgttaccaagctaatgtgttgcttgggtccagatattttcttgggtacctgttatagatgccctaaggaaattgtggatacagtgtcagccttggtttatcataataagctgaaggctaaaaatgataatagctccatgtgttttaaggtctattataaaggccagactacacatgagagttctagtgctgtcaatatgcagcaaatatatttaattagtaagtttttaaaggcaaaccccagttggagtaacgccgtatttattagtccttataatagtcagaactatgttgctaagagagtcttgggtttacaaacccagacagtagattcagcgcagggttctgaatatgattttgttatttattcacagactgcggaaacagcgcattctgtcaatgtaaatagattcaatgttgctattacacgtgctaagaagggtatcctctgtgtcatgagtagtatgcaattatttgagtctcttaattttagcacactgactctggataagatcaataatccacgattacagtgtactacaaatttgtttaaggattgtagcagaagctatgcaggttatcacccagctcatgcgccttcctttttggcagttgatgataaatataaggtaggtggcgatttagccgtttgccttaatgttgctgattctgctgtcacttattcgcggcttatatcactcatgggattcaagcttgacttgacccttgatggttattgtaagctgtttataactagagatgaagctatcagacgtgttagagcctgggtaggctttgatgcagaaggtgcccatgcgacgcgtgatagcattgggacaaatttcccattacaattaggcttttcgactggaattgattttgttgtcgaggccactggaatgtttgccgagagagatggctacgtctttaaaaaggcagtggcacgagcacctcccggcgaacaatttaaacacctcgtcccacttatgtctagaggacagaaatgggacgtggttcgaattcgaatagtacaaatgctgtcagaccacttagtggatttggcagacagtgttgtacttgtgacgtgggctgccagcttcgagctcacatgtttgcgatatttcgctaaagttggaaaagaagttgtgtgtagtgtctgcaacaagcgtgcgacatgttttaattctaggactgggtactatggatgctggcgacatagttattcctgtgattacctgtataacccactaatagttgatattcaacagtggggatatactgggtctttaactagcaatcatgacctcatttgcagcgtgcataagggtgctcatgtcgcatcttctgatgctatcatgacccgatgcttagctgtccatgattgcttttgcaaatctgttaattggagtttagaataccccattatctcaaatgaggttagtgttaatacctcctgcaggttattgcagcgtgtaatgtttagggctgcgatgctatgcaataggtatgatgtgtgttatgacattggcaaccctaaaggtcttgcctgtgtcaaaggctatgattttaagttttatgatgcctctcctgttgttaagtctgttaaacagtttgtttataagtatgaggcacataaagatcaatttttagatggtttatgtatgttttggaactgcaatgtggataagtatcccgcgaatgcagttgtatgtaggtttgacacgagagtgttaaacaaattaaatctccctggctgtaatggtggtagtctgtatgttaataaacatgcattccacaccagtccctttacgcgggcagccttcgagaatttgaagcctatgcctttcttttattactcagatacgccttgtgtgtatatggagggcatggagtctaagcaggtcgattatgtcccattgagaagcgccacttgcattacaagatgcaatttaggtggcgctgtttgtttaaaacatgctgaggattatcgtgagtaccttgagtcttacaatacggcaaccacagcgggttttaccttttgggtctataagacttttgatttttacaacctttggaatacttttactaggctccaaagtttagaaaatgtagtgtataatttggtaaatgctggacactttgatggacgggcgggtgaactgccttgtgccgttataggtgagaaagtcattgccaagattcaaaatgaggatgtcgtggtttttaaaaataacacgccattccctactaatgtggctgttgaattatttgctaagcgcagtattcgaccacacccagagcttaagctctttagaaatttgaatattgacgtgtgctggagtcacgtcctttgggattatgctaaggatagtgtgttttgcagttcgacgtacaaggtctgcaaatacacagatttacagtgcattgaaagcttgaatgtactttttgatggtcgtgataatggtgctcttgaagcttttaagaagtgccgggatggcgtctacattaacacgacaaaaattaaaagtctgtcgatgattaaaggcccacagcgtgccgatttgaatggcgtagttgtggagaaagttggagattccgatgtggaattttggtttgctatgcgtagagacggtgacgatgttatcttcagccgtacagggagccttgaaccgagccattaccggagcccacaaggtaatccgggtggtaatcgcgtgggtgatctcagcggtaatgaagctctagcacgtggcactatctttactcaaagcagatttttgtcctctttcgcacctcgatcagagatggagaaagactttatggatttagatgaagacgtgttcattgcaaaatatagtttacaggactacgcgtttgaacatgttgtttatggtagtttcaaccagaaaatcattggaggtttgcatttgcttattggcttagcccgtaggcagcaaaaatccaatctggttattcaagagttcgtcccgtacgactctagcatccactcgtactttatcactgacgagaacagtggtagcagtaagagtgtgtgcactgttattgatttgttgttaaatgattttgtggacattgtaaagtccctgaatctaaattgtgtgagtaaggttgttaatgtgaatgttgattttaaagatttccagtttatgttgtggtgcaatgaggagaaggtcatgactttctatcctcgtttgcaggctgccgctgattggaaacctggttatgttatgcctgtattatacaagtacttggaatcgccgctggaaagagttaatctctggaattatggcaagccgattactttacctacaggatgtttgatgaatgttgctaagtatactcaattatgccaatatttgaatactacaacattagcagtcccggctaatatgcgtgttttacacctcggagccggttctgataaggatgttgcccctggatctgcagttcttaggcagtggttaccagcaggcagcattcttgtagataatgatataaatccatttgtgagtgacagtgttgcctcatattatggaaattgtataaccttacccatagcgtgtcagtgggatttgataatttctgatatgtacgaccctcttactaagaacattggggagtacaacgtgagtaaagatggattctttacttacctttgtcatttaattcgtgacaagttggctctgggtggcagtgtcgccataaaaattacagagttttcttggaacgctgagttatatagtttaatggggaagtttgcgttttggacaatcttttgcaccaacgtaaacgcctcttcaagtgaaggatttttgattggcataaattggttaaataggacccgtaccgagattgacggtaaaaccatgcatgccaattatttgttttggagaaatagtacaatgtggaatggaggggcttacagtctttttgatatgagtaagttccctttgaaggtggctggtacggctgttgtaagcctaaagccagaccaaataaatgatttagtcctctccttgattgagaagggcaagttattagtgcgtgatacacgcaaggaagtatttgttggcgatagccttgtaaatgttaaataaatctatacttgtcatggctgcgatgcaggcctttgctgacaagcctaatcattttataaacttcccattggcccaatttagtggcgttatgggtaagtatttaaagcttcagtcgcaacttgtggaaatgggtttagactgtaaattacagaaagcaccacatgttagtattaccatgctcgatattagagcagatcaatacaaacaggtggaatttgcaatacaagaagtaatagatgatatggcggcatatgagggagatattgtctttgacaaccctcacatgcttggcagatgtcttgttcttgatgttaaaggatttgaagagttgcatgaagatatagttgaaattctccggaaaaggggttgcatagcagatcaatccagacaatggattcctcactgtactgtggcccaatttgaggaagaaaaagaaataaatgagctgcaattctattataaattacccttctacctcaagcataacaacatattaacggatgctaggcttgagcttgtgaagataggttcttccaaaacagatgggttctattgtagtgagctgagcatttggtgtggtgagagactttgttacaagcctccaacacccaaatttagtgatatatttggctattgctgcattgataaaatacgtgttgacttagaaattggtgacctacccgaggatgatgaagaagcgtgggccgagctaagttaccactatcaaagaaacacctacttcttccgctacgtacatgataatagcatttattttcgtaccgtatgcagaatgaagggttgtatgtgttgatttggttttacactagtagtgtaataagcttattattttgttgaaaagggcaggatgtgcatagctatggctcctcgcacactgcttttgctgatttgatgtcagctggtgtttgggttcaatgaacctcttaacatcgtttcacatttaaatgatgactggtttctatttggtgacagtcgttctgactgtacctatgtagaaaataacggtcatcctaaattagattggcttgacctcgacccaaagttgtgtaattcaggaaagatttccgcaaagagtggtaactctctctttaggagttttcacttcactgatttttacaattatacgggtgagggagaccaaattgtattttatgaaggagttaattttagtcccagccatggctttaaatgcctggctcatggagataataaaagatggatgggcaataaagctcgattttatgcccgagtgtatgagaagatggcccaatataggagcctatcgtttgttaatgtgtcttatgcctatggaggtaatgcaaagcccgcctccatttgcaaagacaatactttaacactcaataaccccaccttcatatcgaaggagtctaattatgttgattagtaccgctctgtggttttaatggccattccaagggcagctcttcggatgctgccaataaatattatactgactctcagagttactataatatggatattggtgtcttatatgggttcaattcgaccttggatgttggcaacactgctaaggatccgggtcttgatctcacttgcaggtatcttgcattgactcctggtaattataaggctgtgtccttagaatatttgttaagcttaccctcaaaggctatttgcctccataagacaaagcgctttatgcctgtgcaggtagttgactcaaggtggagtagcatccgccagtcagacaatatgaccgctgcagcctgtcagctgccatattgtttctttcgcaacacatctgcgaattatagtggtggcacacatgatgcgcaccatggtgattttcatttcaggcagttattgtctggtttgttatataatgtttcctgtattgcccagcagggtgcatttctttataataatgttagttcctcttggccagcctatgggtacggtcattgtccaacggcagctaacattggttatatggcacctgtttgtatctatgaccctctcccggtcatactgctaggtgtgttattgggtatagctgtgttgattattgtgtttttgatgttttattttatgacggatagcggtgttagattgcatgaggcataatctaaacatgctgttcgtgtttattctatttttgccctcttgtttagggtatattggtgattttagatgtatccagcttgtgaattcaaacggtgctaatgttagtgctccaagcattagcactgagaccgttgaagtttcacaaggcctggggacatattatgtgttagatcgagtttatttaaatgccacattattgcttactggttactacccggtcgatggttctaagtttagaaacttcgctcttacgggaactaactcagttagcttgtcgtggtttcaaccaccctatttaagtcagtttaatgatggcatatttgcgaaggtgcagaaccttaagacaagtacgccatcaggtgcaactgcatattttcctactatagttataggtagtttgtttggctatacttcctataccgttgtaatagagccatataatggtgttataatggcctcagtgtgccagtataccatttgtcagttaccttacactgattgtaagcctaacactaatggtaataagcttatagggttttggcacacggatgtaaaacccccaatttgtgtgttaaagcgaaatttcacgcttaatgttaatgctgatgcattttattttcatttttaccaacatggtggtactttttatgcgtactatgcggataaaccctccgctactacgtttttgtttagtgtatatattggcgatattttaacacagtattatgtgttacctttcatctgcaacccaacagctggtagcacttttgctccgcgctattgggttacacctttggttaagcgccaatatttgtttaatttcaaccagaagggtgtcattactagtgctgttgattgtgctagtagttataccagtgaaataaaatgtaagacccagagcatgttacctagcactggtgtctatgagttatccggttatacggtccaaccagttggagttgtataccggcgtgttgctaacctcccagcttgtaatatagaggagtggcttactgctaggtcagtccccagccctctcaactgggagcgtaagacttttcagaattgtaattttaatttaagcagcctgttacgttatgttcaggctgagagtttgttttgtaataatatggatgcttccaaagtgtatggcaggtgctttggtagtatttcagttgataagtttgctgtaccccgaagtaggcaagttgatttacagcttggtaactctggatttctgcagactgctaattataagattgatacagctgccacttcgtgtcagctgcattacaccttgcctaagaataatgtcaccataaacaaccataacccctcgtcttggaataggaggtatggctttaatgatgctggcgtctttggcaaaaaccaacatgacgttgtttacgctcagcaatgttttactgtaagatctagttattgcccgtgtgctcaaccggacatagttagcccttgcactactcagactaagcctaagtctgcttttgttaatgtgggtgaccattgtgaaggcttaggtgttttagaagataattgtggcaatgctgatccacataagggttgtatctgtgccaacaattcatttattggatggtcacatgatacctgccttgttaatgatcgctgccaaatttttgctaatatattgttaaatggcattaatagtggtaccacatgttccacagatttgcagttgcctaatactgaagtggttactggcatttgtgtcaaatatgacctctacggtattactggacaaggtgtttttaaagaggttaaggctgactattataatagctggcaaacccttctgtatgatgttaatggtaatttgaatggttttcgtgatcttaccactaacaagacttatacgataaggagctgttatagtggccgtgtttctgctgcatttcataaagatgcacccgaaccggctctaatctatcgtaatataaattgtagctatgtttttagcaataatatttcccgtgaggagaacccacttaattactttgatagttatttgggttgtgttgttaatgctgataaccgcacggatgaggcgcttcctaattgtgatctccgtatgggtagtgggctttgtgtcaactattcaacgtctcaccgcgctcgcagctctgtcagcacgggttataaattaactacttttgaaccatttacagtccgcattgtcaatgatagtgttgagtctgttgatgggttatatgagctgcaaataccaaccaactttactatagctagccatcaggagttcgttcaaacgaggtctccaaaggttactatagactgtgctgcatttgtctgtggtggccacacagcatgccgtcagcagttggttgagtacggctcattctgtgataatattaatgccattcttggcgaggtaaataacctcatagatactatgcaacttcaagttgcaagtgctttaatccaaggtgtcacgttaagctcacgcttatcggatggcattggtggtcaaatagatgatattaattttagtcctctgcttggttgtttaggttctgactgtggcgaagttaccatggcagctcaaaccggacgatctgctatagaggatgtattatttgacaaagtcaaactctctgatgttggctttgtcgaagcatataacaattgcactggaggccaagaagttagagacctactttgtgtgcaatcttttaatggcatcaaagtgctaccgcctgtgttgtctgagaatcaaatttctggttatacagcgggagctactgtatctgctatgttcccatggtctgcagctgcaggtgtgccattttctttaagtgttcaatatagaattaatggtcttggtgtcactatgaatgttcttagtgaaaatcagaaaatgatagcaagtgcatttaacaacgcgataggtgctatacaggaagggtttgctgcaaccaattctgccttagcaaaaatgcagttcgttgtcaatgcaaatgcggaagcactcaataatttattaaaccagctttccaataggtttggtgcaattagtgcttctttacaagaaattctatctcgcctagatgctcttgaagcgcaggctcagatagaccgtcttattaatggcagattaactgcacttaatgcatatgtctctaagcagctgagtgacatgacccttgttaaggtgagtgcagcccaggctatagagaaagttaatgagtgtgttaaaagccaatcatctaggataaatttctgtggcaatggcaatcatatattgtcattagtccagaatgcgccttatggtttatattttattcatttcagctatgtgcctacttcctttacaacggcaaatgtgagtcctgggctatgcatttctggtgatagaggattagcacctaaagctggatattttgttcaagatgatggagagtggaagttcacaggtagtaattattattaccctgaacccattacagataaaaatagtgtcgtgatgagtagttgcgcagcaaactacacaaaggcacctgaagttttcttgaacacttcaatacctaatctacccgactttaaggaggagttagataaatggtttaaaaatcagacgtctattgcgcctgatttatctctcgatttcgagaaattaaacgttaccctcctggacctgactgatgagatgaacaggattcaggatgcaattaagaagttaaatgagagttacatcaacctcaaggacgttggcacatatgaaatgtatgtgaaatggccttggtatgtgtggttgctaattggattagctggtgtagctgtttgtgtgttgttatttttcatatgttgctgcacgggttgtggctcatgttgtttcaagaagtgtggaaattgttgtgatgagtgtggaggacaccaggacagtattgtgatacataatatttcctctcatgaggattgactatcacagcctctcctggaaagacagaaaatctaaacaatttattgcactttccccgctacttggccccgtaagaggcagccatagctatggccgtgtagggtcctaaagctacattggctgctgtctttatcggtccatttattgtagcatgtatgctaggcattggcctagtttattcattgcaattgcaagtttaaatttttcatgttaatgataccatacgtgtgactggcaagccagccactgtgtcttatactataagtacaccagtaacgccgagtgccacgacgctcgacggtactacgtatactttaattagacccataagctcttatacaagagtttaccttggcaaaaccagagggtttgatactggtacatttggcccaaaggtcttggactatgttactaatctaaacctcatcttaattctggtcgtccatacaccttccgtaagcttggtttatgagaccgacagccacatggacatatggcatgtgagtgatgcttggttacgccgaacgcgagactttggtgtcactcgccttgaagatttttgctttcaatttaattattgccaacctcgaattggttattgtagagttcctttaaaggcttggtgtagcaaccagggtaaatttgcagcgcagtttacccttaaaagttgcgaaaaatcaggccaagaaatatttattactagcttcacggcctacgacaaaactgtcaaaaaggccgttagtaagctagtagaagaagctgttgattttatcatctggagagccacgcagctcgaaagatatgtttaatttattccttacagatacagtatggtatgtggggcagattatttttatagtcgcagtgtgtttgatggtcaccataatagtggttgccttccttgcgtctatcaaactttgtattcaactttgcggtttgtgtaatactttgttgctgtctccttctatttgtgtgtataataggagtaagcagctttataagtattataatgaagaagtgagaccgcccccgttagaggtggatgatataataatccaaacattatgaatagtaccactcaggctccacagcctgtttatcagtggacggctgatgaggcaattcgattccttaaggaatggaatttctctctcggcattatactactttttgttactatcatactacagttcggttacacgagccgtagcatgtttgtttatgttgtgaaaatgatacttttgtggcttatgtggccactaactattgttttgtgtatttttaactgcgtctatgcgctaaataatgtgtatcttggattttctatagtgtttactatagtgtccattataatgtggattatgtattttgttaatagcatcaggttgtttatcaggactggcagctggtggagcttcaaccccgaaacaaacaacctaatgtgtatagatatgaaaggtactgtgtatgttagacccattatagaggattaccatacactaacagccactatcattcgtggtcacctctatatgcaaggtgttaagctaggcactggcttctctttgtctgatttgcctgcttatgttacagttgctaaggtgtctcacctttgcacttataagcgcgcattcttagacaaggtagacggtgttagcggttttgctgtttatgtgaagtccaaggtcggaaattaccgactgccctcaaataaaccgagtggcatggacaccgcattgttgagaatctaatctaaactttaaggatgtcttttgttcctgggcaagaaaatgccggtagcagaagctcctctggaaaccgcgctggtaatggcatcctcaagaagaccacttgggctgaccaaaccgagcgtggaaatagaggcagaaggaaccatcccaagcagactgcaactactcagcccaatgccgggagtgtggttccccattactcttggttttcgggcatcacccagtttcaaaagggaaaggagttccagtttgcacaaggacagggagtgcctattgccagtggaatccccgcttcagagcaaaagggatattggtatagacacaaccgacgttcttttaaaacacctgatggccagcacaagcagctactgcccagatggtatttttactatcttggaacagggccccatgctggcgcagagtatggcgacgatatcgaaggagttgtctgggtcgcaagccaacaggccgacactaagaccactgccgatgttgttgaaagggacccaagcagtcatgaggctattcctactaggtttgcgcccggcacggtattgcctcagggcttttatgtagaaggctcgggaaggtctgcacctgctagtcgatctggttcgcggtcacaatcccgtgggccaaataatcgcgctagaagcagttccaaccagcgccagcctgcctctgctgtaaaacctgacatggccgaagaaattgctgctcttgttttggctaagcttggtaaagatgccggccagcccaagcaggtaactaagcaaagcgccaaagaagtcaggcagaaaattttaactaagcctcgtcaaaagaggactccaaacaagcagtgcccagtgcagcagtgttttgggaagagaggccctaatcagaactttggaggctctgaaatgttaaaacttggaactagtgatccgcagttccccattcttgcagagttggctccaacacctagtgccttcttctttggatctaaattagaattggtcaaaaagaactctggtggtgctgatgaacccaccaaagatgtttatgaattgcagtattcaggtgcaattagatttgatagtactctacccggttttgagactatcatgaaagtgttgactgagaatttgaatgcctaccaggaccaagctggtagtgtagatctagtgagcccaaagcctccaagaagaggtcgtagacaggctcaagaaaagaaagatgaagtagataatgtaagcgttgcaaagcccaaaagcttggtgcagcgaaatgtaagtagagaattaacccccgaggatcgtagcctgctggctcagatcctagacgatggcgttgtgccagatgggttggaagatgactctaatgtgtaaagagaatgaatcctatgtcggcgctcggtggtaacccctcgcgagaaagtcgggataggacactctctatcagaatggatgtcttgctgtcataacagatagagaaggttgtggcagaccctgtatcaattagttgaaagagattgcaaaatagagaatgtgtgagagaagttagcaaggtcctacgtctaaccataagaacggcgataggcgccccctgggaagagctcacatcagggtactattcctgcaatgccctagtaaatgaatgaagttgatcatggccaattggaagaatcacaaaaaaaaaaaaa

SEQ ID NO: 42 - DNA, 28033 bp, Coronavirus
acttaaaaagattttctatctacggatagttagctctttttctagaccttgtctactcaattcaactaaacagaaattttgtccttccttccggccgcatgttcatgctgctggaagctggcgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgccggctatggctagcaaccatgtcacattggcgtttgccaatgatgcagaaatttcggcttttggcttttgcactgctagtgaagccgtctcatactattctgaggccgccgctagtggatttatgcaatgccgttttgtgtccctcgatctcgctgacactgttgagggattgcttcctgaagactatgtcatggtggtgatcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagatttcttcgctgactccgaagacggtcaactcaacattgctgggatcacttatgtgaaggcctggattgtagagcgatcggacgtctcttatgcgagtcagaatttaacatctattaagtctattacttactgttcaacctatgagcatacttttcttgatggtactgccatgaaggttgcacgtactccaaagatcaagaagaatgttgttttgtctgagccacttgctactatctacagggaaattggttccccttttgtggataatgggagcgatgctcgttctatcattaggagaccagtgttcctccacgcttttgttaagtgtaagtgtggtagttatcattggactgttggtgattggacttcctatgtctccacttgctgtggctttaagtgcaagccagtccttgtggcctcatgctctgctatgcctggttctgttgtggtcacacgcgctggtgctggcactggtgttaagtactacaacaacatgttcctgcgccatgtggctgacattgatggattggcattctggcgaattcttaaggtgcagtccaaagacgacctcgcttgctctggtaagttccttgaacaccatgaggaaggtttcacagacccttgctactttttgaatgattcgagccttgctactaagcttaagttcgacatccttagtggcaagttttctgatgaagtcaaacaagctatcattgctggtcatgttgttgttggcagtgcactcgttgacattgttgacgatgcactgggacaaccttggttcatacgtaagcttggtgaccttgcaagtgcaccttgggagcagcttaaggctgtcgttagaggccttggcctcttgtctgatgaggttgtgctctttggcaaaagacttagctgtgccactcttagtatcgttaacggcgtttttgagtttctcgccgatgtgccagagaagttggctgcggctgttacagtttttgtcaacttcttgaatgagttctttgagtctgcctgtgactgcttaaaggtcggaggtaagacattcaacaaggttggttcctatgttctttttgacaatgcattggttaagcttgtcaaggcaaaagctcgcggcccacgacaggcaggtatttgtgaagttcgctacacaagcctggttgttgggagtactaccaaggtggtttccaagcgcgttgaaaatgccaatgtgaatctcgtcgtcgttgacgaggatgtaaccctcaacaccactggtcgtacagttgtcgttgatggacttgcattcttcgagagtgacgggttttacagacatcttgctgatgctgacgttgtcatcgaacatcctgtttataagtctgcttgtgagctcaagccagtttttgagtgtgacccaatacctgattttcctttgcctgtggccgctagtgttgcagagctctgtgtgcaaaccgatctgttgcttaaaaattacaacactccttataaaacttacagctgcgtagtgagaggtgataagtgttgcatcacttgcaccttacagttcaaagcaccaagttatgtggaggatgctgttaattttgtagacctatgtaccaagaacattggtactgctggttttcatgagttttacataacggcccatgaacaacaggatctgcaagggtttttaaccacttgttgcacgatgtcaggttttgagtgttttatgcctacaatcccacagtgtccagcagtgcttgaagagattgatggtggtagcatatggcggtcttttatcactggtcttaatacaatgtgggatttttgcaagcgtcttaaagtcagctttggactggatggcattgttgtcactgtagcacgcaaatttaaacgacttggtgctcttttggcagaaatgtataacacttatctttcaactgtggtggaaaacttggtactggccggtgttagcttcaagtattatgccaccagtgtcccaaaaattgttttgggcggttgttttcacagtgttaaaagtgtttttgcaagtgtcttccagattcctgtccaggcaggcattgagaagtttaaagttttccttaactgtgttcaccctgttgtaccacgtgtcattgaaacttcttttgtggaattagaagagacgacatttaaaccaccagcactcaatggtggtattgctattgttgatggcttcgctttctattatgatggaacactatactatcccaccgatggtaatagtgttgtgcctatctgttttaagaagaaaggtggtggtgatgttaaattctctgatgaagtctctgttaaaaccattgatccagtttataaggtctcccttgaatttgagttcgagtctgagactattatggctgtgcttaataaggctgttggtaatcgtatcaaggttacaggtggttgggatgatgtcgttgagtatattaacgttgccattgaggttcttaaagatcacgttgaagtgcctaagtactacatctatgatgaggaaggtggcactgatcctaatctgcccgtaatggtttctcagtggccgttgaatgatgacacgatctcacaggacctgcttgatgtggaagttgttacggatgcaccaattgattccgagggtgatgaagtagactcctctgcacctgagaaggtggcagatgtggctaactctgaacctggggatgatggtcttcctgtggcacctgaaacaaatgtagagtctgaagttgaggaagttgccgcaaccttgtcctttattaaagatacaccttccacagttactaaggacccttttgcttttgactttgtaagctacggaggacttaaagttttaagacaatctcataacaattgttgggttacttctaccttggtgcagctacaattgcttggcatcgttgatgaccctgcaatggaactttttagtgctggtagagttggtccaatggttcgcaaatgttatgagtcacaaaaggctattttgggatctttgggtgatgtgtcggcttgcctagagtctctgactaaggacctacacacacttaagattacctgttctgtagtctgcggttgtggtactggtgaacgtatctatgagggttgtgcttttcgtatgacgccaactttggaaccgtttccatatggtgcttgtgctcagtgtgctcaagttttgatgcacacttttaaaagtattgttggcaccggcatcttttgccgagatactactgctctctccttggattctttggttgtaaaacctctttgtgcggctgcttttataggcaaggatagtggtcattatgtcaccaatttttatgatgctgctatggctattgatggttatggtcgtcatcagataaagtatgacacactgaacaccatttgtgttaaagacgtgaattggacagcacctcttgtccctgccgttgattctgtagtggagcctgttgtcaaaccattctattcttataagaatgttgatttttaccaaggagattttagtgaccttgttaaacttccatgtgactttgttgttaatgctgcaaatgagaagttgtctcatggtggcggcatagcaaaggccattgatgtttataccaagggcatgttgcagaagtgttcaaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaactcaggtgttgctcttacacctttgattagtgttggaatttttagtgttcctttggaagaatctttatctgcttttcttgcatgtgttggtgatcgccactgtaagtgcttttgttatggtgacaaagagcgcgaggcgatcattaagtacatggatggcttggtagatgctattttcaaagaggcgcttgttgacactactcctgtccaggaagatgttcaacaagtttcacaaaaaccagttttgcctaattttgaacctttcaggattgaaggtgctcatgctttctatgagtgcaaccctgaaggtttgatgtccttaggtgctgacaagctggtgttgtttacaaattccaatttggatttttgtagtgttggtaagtgtcttaacgatgtgaccagcggtgcattgcttgaagccataaatgtatttaaaaagagtaacaaaacagtgcctgctggcaactgtgttactttagattgtgcaaatatgatttctattactatggtagtattgccatttgatggtgatgctaattatgacaaaaattatgcacgcgccgttgtcaaggtatctaagcttaaaggcaagttagtgcttgctgttgatgatgccacgttgtattccaagttgtcccacctcagcgtgttaggtttcgtgtccacacctgacgatgtggagcgtttctacgcaaataagagtgtggttattaaagtcactgaggatacacgtagtgtcaaggctgttaaagtagaatccactgctacttatggacaacaaattggaccttgtcttgttaatgacaccgttgtcacagacaacaaacctgttgtcgctgacgttgtagctaaggttgtaccaaatgctaattgggattcacattatggttttgataaggctggtgagttccacatgctagaccatactgggtttacctttcctagcgaagttgttaacggtaggcgtgtgattaaaaccacagataataattgttgggttaatgtcacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgttcctgctggttctgtcactattgaacgtgtcacgcatgacggctgttgttgtagtaagcgtgttgttactgcaccagttgtgaatgctagtgtgttgaagcttggcgtcgaggatggcctttgtccacatggtcttaactacattggcaaagttgttgtagttaaaggtactacaattgttgtcaatgtaggaaaacctgtagtggcaccatcacacctctttcttaagggtgtatcctacacaacattcctagataatggtaacggtgttgtcggccattatactgtttttgatcatggcactggtatggtgcatgatggcgatgcttttgtaccgggtgatcttaatgtatctcctgttacaaatgttgttgtctcagagcagacggctgttgtgattaaagaccctgtgaagaaagcagagttagacgctactaagctgctcgacactatgaattatgcatcggaaagatttttttcctttggtgatttcatgtcacgtaatttaattacagtgtttttgtacatccttagcattttgggtctctgttttagagcctttcgtaagagagatgttaaagttctagctggtgtaccccaacgtactggtattatattgcgtaaaagtatgcgctataatgcaaaggcgttgggtgtctttttcaagctaaagctttattggttcaaagttcttggtaagtttagtctgggtatttatgcattgtatgcattactattcatgacaatacgctttacacctataggtagccccgtctgtgatgatgttgttgctggttatgctaattctagttttgacaagaatgagtactgcaacagtgttatttgtaaggtctgtctctatgggtaccaggaactctcggacttctcccacacacaggttgtatggcaacaccttagagacccattaattggtaatgtgatgcctttcttttatttggcatttttggcaatttttgggggtgtctatgtaaaggctattactctctattttattttccagtaccttaatagtcttggtgtgtttttgggcctacagcagtccatttggtttttgcagctcgtgccttttgatgtctttggtgatgagatcgtcgtctttttcatcgttacacgcgtattgatgttcattaagcatgtttgccttggctgcgataaggcatcttgtgtggcttgctctaagagtgctcgccttaagcgcgttcctgtccagactatctttcagggtactagtaaatccttctacgtacatgccaatggtggttctaagttctgtaagaagcacaatttcttttgtttaaattgtgattcttatggtccaggctgcacttttattaacgacgtcattgcaactgaagttggtaatgttgtcaaacttaatgtgcaaccgacaggtcctgccactattcttattgacaaggttgaattcagtaatggtttctactatctttatagtggtgacacattttggaagtacaactttgacataacagatagcaaatacacttgcaaagaggcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagtttcggcaaagacctgtcaagttgtaatgacatgcaggattgcaagagcacattgggttttgatgatgtaccattggatacctttaatgctgctgttgctgaggctcatcgctatgatgtcctcttgactgacatgtcattcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataacatttatgttgacctttaatgattgtcgtatgcatactaccatacctactgtttgcattgcaaataagaagggtgcaggtcttcctagtttttcaaaggttaagaaattcttttggtttttgtgtctgttcatagttgctgctttctttgcactaagctttcttgattttagtactcaggttagcagtgatagcgattatgatttcaagtatattgagagtggccagttgaagacttttgacaatccacttagttgtgtgcataatgtctttattaacttcgaccagtggcatgatgccaagtttggtttcacccccgtcaacaatcctagttgtcctatagttgttggtgtatcagacgaagctcgcactgttccaggtatcccagcaggtgtttatttagctggtaaaacacttgtgtttgctattaacaccatttttggtacatctggtttgtgcttcgatgctagtggcgttgctgataagggcgcttgcatttttaattcagcttgcaccacattatctggtttgggtggaactgctgtctactgttacaagaatgggctagttgaaggtgccaaactttatagtgagttggcacctcatagctactataaaatggtagatggtaatgctgtgtctttacctgaaattatttcacgcggctttggcatccgtactatccgtacaaaggctatgacttattgccgtgttggccagtgtgtgcagtctgcagaaggcgtttgttttggcgccgatagattctttgtctataatgcagaatctggttctgactttgtttgtggcacagggctcttcacattgttgatgaacgttattagtgttttttccaagacagtaccagtaactgtgttgtctggtcaaatactttttaattgcattattgcttttgttgctgttgcggtgtgtttcttatttacaaagtttaagcgcatgttcggtgatatgtctgttggcgttttcactgtcggtgcttgtactttgttgaacaatgtttcttacattgtaacacagaacacacttggcatgttgggctatgcaactttgtatttcttgtgcactaagggtgttagatatatgtggatttggcacttgggatttttgatctcatatattcttattgcaccatggtgggttttgatggtttatgccttttcagccatttttgagtttatgcctaacctttttaagcttaaggtttcaacacaactttttgagggcgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcataacgatacgttatacacaccacccactgtgagttacaattcaactctacaggctggcttgcgtaagatggcacaaccttctggtgttgttgagaagtgcatagtccgtgtttgctatggtaatatggctcttaatggcctatggcttggcgatattgttatgtgcccacgccatgttatagcgtctagtactactagcactatagattatgattatgccctttctgttttacgcctccacaacttctccatttcatctgggaatgttttcctaggtgttgtgagtgcaactatgcgaggtgctttgttgcagataaaggttaatcaaaacaatgtccacacgcctaagtacacctatcgcacagttagaccgggtgaatcttttaatattttggcgtgctatgatggtgctgcagctggtgtttacggcgttaacatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggatcgctgtagacaggtttaatgagtgggctgttcataatggtatgacaacagtgggcaatactgattgcttttctattcttgctgctaagactggagttgatgtacaacgtttgttggcctcaatccagtctctgcataagaattttggtggaaagcaaattcttggccatacctcgttgacagatgagtttactacaggtgaagttgtacgtcaaatgtatggcgttaatcttcagggtggctatgtgtcacgcgcctgcagaaatgtcttgctggttggttcttttctgactttcttttggtcagaattagtttcctacactaagttcttctgggtaaatcctggttatgttacacctatgtttgcgtgcttgtcattgctatcctcacttttgatgttcacactcaagcataagacattgtttttccaggtcttcttaatacctgctctgattgttacatcttgcattaatttggcatttgatgttgaagtctacaactatttggcagagcattttgattaccatgtttctcttatgggttttaatgcacaaggtcttgttaacatctttgtctgctttgttgttaccattttacacggcacatacacatggcgcttctttaatacacctgcgagttctgtcacttatgtggtagctttgctgactgcggcctataactatttttacgctagtgacattcttagttgtgctatgacactatttgctagtgtgactggcaactggttcgttggtgctgtttgttataaagttgctgtgtatatggccttgagatttcctacgttcgtggctatttttggtgatattaagagtgttatgttctgttaccttgtgttgggttattttacctgttgcttctacggtattctctactggttcaacaggttctttaaggttagtgtaggtgtctatgactatactgttagtgctgctgagtttaagtatatggttgctaatggcctacgtgcaccaactggaacacttgattcactactgttgtccgccaaattgattggtattggtggtgagcggaatattaagatttcttccgttcagtctaaactgactgatattaagtgtagtaacgttgtgcttttaggctgtctttctagcatgaatgtttcagcaaattcaacagaatgggcttattgtgttgacttgcataacaagatcaacttgtgtaatgacccagaaaaagcgcaggaaatgctacttgctttgttggcatttttccttagtaagaatagtgcctttggtttagacgacttattggaatcttattttaatgacaatagtatgttgcagagtgttgcatctacttatgtaggtttgccttcctatgtcatttatgaaaatgcacgccaacagtatgaagatgctgttaataatggttctccacctcagttggttaagcaattgcgccatgctatgaatgtagcaaagagcgaatttgaccgtgaggcttctactcagcgtaagcttgatagaatggcggaacaggctgcagcacagatgtataaagaggcaagggcagttaataggaagtccaaagttgtaagtgctatgcattcactgctttttggtatgttgagacgtttggatatgtcttctgtagacaccattctcaacttggcaaaggatggggtggtacctctgtctgtcataccggcagtcagtgctactaagcttaacattgttacctctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgttaagctccagaataatgagattattcctggtaagctgaagcagcgctccattaaggcagaaggagatggcatagttggagaaggtaaggcactttacaataatgagggtggacgtacttttatgtatgctttcatttcagataaaccggacctgcgtgtagttaagtgggagttcgatggtggttgtaacactattgagctagaaccaccacgtaagttcttggtggattctcctaatggtgcacagatcaagtatctctactttgttcgtaaccttaacacgttgcgtaggggtgctgttcttggctacataggtgccactgtacgcttgcaggctggtaaacaaacagaacaggctattaactcttcattgttgacactttgcgctttcgctgtggatcctgctaagacctacatcgatgctgttaaaagtggtcacaaaccagtaggtaactgtgttaagatgttggccaatggttctggtaatggacaagctgttactaatggtgtggaggctagtactaaccaggattcatatggtggtgcttccgtgtgtctatattgtagagcacatgttgagcatccatctatggatggtttttgcagactgaaaggcaagtatgtacaggtgccactaggtacagtggatcctatacgttttgtacttgagaatgacgtttgcaaggtttgtggttgttggctgtctaatggctgcacttgtgacagatccattatgcaaagcactgatatggcttatttaaacgagtacggggctctagtgcagctcgactagagccctgtaatggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggggccatagccgaacacgatttcttcacttggaaggatggtcgtgcaatctatggtaacgtttgtagaaaggatcttaccgagtatactatgatggatctgtgttacgctttacgtaactttgatgaaaacaattgcgatgttcttaagagcattttgattaaggtaggtgcttgtgaggagtcctactttaataataaagtctggtttgaccctgttgaaaatgaagacattcatcgtgtctatgcattgttaggtaccattgttgcacgtgctatgcttaaatgcgttaagttctgtgatgcaatggttgaacaaggtatagttggtgttgtcacattagataatcaggatcttaatggtgatttttatgattttggtgattttacttgtagtatcaagggaatgggtgtacccatttgcacatcatattactcttatatgatgcctgttatgggtatgactaattgccttgctagtgagtgttttgttaagagtgatatatttggtgaggattttaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactaccatacctattacggcatttggacctttgtgtcgcaagtgctggattgatggtgttccactggtaactacagctggttatcattttaaacagttaggtatagtttggaataatgacctcaacttacactctagcaggctctctattaatgaattactccagttttgtagtgatcctgcactgcttatagcatcatcaccagcccttgttgaccagcgtactgtttgcttttcagttgcagcgctaggtacaggtatgactaaccagactgtgaaacctggccatttcaataaggagttttatgacttcttacttgagcaaggtttcttctctgagggctctgagcttactttaaagcacttcttctttgcacagaaggttgatgcagctgttaaggattttgactactataggtataatagacccactgttctggacatctgccaagctcgcgtcgtgtatcaaatagtgcaacgctattttgatatttacgagggtggttgtatcactgctaaagaagtggttgttacaaaccttaacaagagcgcaggctatcctttgaacaagtttggtaaagctggtctttactatgagtctttatcctatgaggaacaggatgaactttatgcttatactaagcgtaacatcctgcccactatgacacagctcaaccttaaatacgctattagtggcaaagaacgtgcacgcacagtgggtggtgtctcgcttttgtcaaccatgaccactcggcagtatcatcagaaacaccttaaatccatagttaatactaggggcgcttcggttgttattggtactactaagttttatggtggttgggacaatatgcttaagaaccttattgatggtgttgaaaatccgtgtcttatgggttgggattacccaaagtgcgatagagcactgcccaatatgatacgcatgatttcagccatgatcttaggctctaagcacaccacatgctgcagttctactgaccgctttttcaggttgtgcaatgaattggctcaagtccttactgaggttgtttattctaatggagggttttatttgaagccaggtggtactacctctggtgatgcaaccaccgcatatgcaaactcagttttcaatatcttccaagcagtaagtgccaatgttaacaaacttcttagtgttgacagcaatgtctgtcataacttagaagttaagcaattacaacgtaagctctatgagtgctgttatagatcgactatcgtcgatgaccagttcgtcgttgagtattatggttacttgcgtaaacatttttcaatgatgattctttctgatgatggcgttgtttgttataacaatgactatgcatcacttggttatgtcgcggatcttaacgcattcaaggctgttttgtattaccagaacaacgtcttcatgagcgcctctaaatgttggatcgagcctgacattaataaaggtcctcatgaattttgttcgcagcatactatgcagattgtcgataaggagggtacttattaccttccttaccctgatccttcaagaatcctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtataaaactttgaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaaccaagctctacttaggtggtcttagttactggtgtcatgaacacaagccacgtcttgcattcccgttgtgctctgctggtaatgtttttggcttatacaaaaattctgctaccggttcacccgatgttgaagactttaatcgcattgctacatccgattggactgatgtttctgactacaggttggcaaatgatgtcaaggactcattgcgtctatttgcagcggaaactatcaaggccaaggaggagagcgttaagtcatcctatgcttgtgcaacactacatgaggttgtaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgacgctgtaacatataaaactaccgccacaacaaaacttgttcctggcatggtttttgtgcttacctcacataatgttcagccattgcgtgcaccaaccattgctaatcaagaacgttattccactatacataagttgcatcctgcttttaacatacctgaagcttattctagcttagtgccctattaccaattgattggtaagcagaagattacaactatccagggaccccccggtagtggtaaatctcactgtgttatagggctaggtttgtactatccaggtgcacgtattgtgtttacagcttgttctcatgcagcggtcgattcactctgtgtgaaggcctccactgcttatagcaatgacaaatgttcacgcatcataccacagcgtgctcgtgttgagtgttatgatggtttcaagtctaataatactagtgctcagtaccttttctccactgtcaatgctttgccagagtgtaatgcggacattgttgtggtggatgaagtttctatgtgcactaattatgacttgtctgtcataaatcagcgcatcagctataggcatgtagtctatgttggtgaccctcaacagctgcctgcaccacgtgttatgatttcacgtggtactttggaaccaaaggactacaatgttgtcactcaacgtatgtgtgcccttaagcctgatgtcttcttgcacaagtgttatcgctgtcctgcagagatagtgcgcactgtgtctgagatggtctatgaaaaccaattcattcctgtgcaccctgacagcaagcagtgttttaagatcttttgcaagggtaatgtgcaggttgataacggttcaagtattaaccgcaggcaattggatgttgtgcgtatgtttttggctaaaaatcctaggtggtcaaaggctgttttcatttccccttataacagccagaattatgttgccagccgtttgctaggtttacaaattcagacagttgattcatcccagggtagtgagtatgactatgtcatttacgcacaaacctcagatactgcccatgccagtaatgttaacaggtttaatgttgccatcacaagggctaagaaaggcatattatgtataatgtgcgataggtccctttttgatctgcttaaattttttgagcttaaattgtctgatttgcaggctaatgagggttgtggtctttttaaagactgtagcagaggtgatgatttgttgccaccgtctcatgctaataccttcatgtctttagcggacaattttaagactgatcaatatcttgctgttcaaataggtgttaatggacccattaaatatgagcatgttatctcgtttatgggtttccgttttgatattaacatacccaaccaccacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaattcgcacaccttttgcctttacttaaacgcggccaaccatgggatgtggttcgcaagcgtatagttcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgcattgtgcaatcacacactatgcgttcagttcttaagttatacaatccaaaagccatatatgatattggcaatcctaagggcattagatgcgccgtaacggatgctaagtggttctgctttgacaagaatcctactaattctaatgtcaagacattggagtatgactatataacacacggccaatttgatgggttgtgcttgttttggaattgcaatgtggacatgtatccagaattttctgtggtctgtcgttttgatactcgctgtaggtcaccactcaacttggagggttgtaatggtggttcactgtatgttaacaatcatgcattccacacaccggcttttgacaagcgtgcttttgctaagttgaagccaatgccatttttcttctatgatgatactgagtgtgacaagttacaggactccataaactatgttcctcttagggctagtaactgcattactaaatgtaatgttggtggagctgtttgtagtaagcattgtgctatgtatcatagctatgtcaatgcttacaacacctttacgtcagcgggctttacgatttgggtgcccacttcgtttgacacctataatctgtggcagacatttagtaacaatttgcaaggtcttgagaacattgctttcaatgttttaaagaaaggatcttttgttggtgatgaaggtgagcttcctgtagctgtggtcaatgacaaagtgctcgttagagatggtactgttgatactcttgtttttacaaacaagacatcactacccactaacgtagcttttgagttgtatgccaagcgtaaggtaggactcacccctcccattacgatcctacgtaacttgggtgttgtttgtacatctaagtgtgtcatttgggactatgaagccgaacgtccacttactacttttacaaaggatgtctgtaaatataccgactttgagggtgacgtttgtacactctttgataacagcattgttggttcattagagcgattctctatgacccagaatgctgtgcttatgtcacttacagctgttaaaaagcttactggcataaagttaacttatggctatcttaatggtgtcccagttaacacacatgaagataaaccttttacttggtatatttacactaggaagaacggcaagttcgaggactatcctgatggctattttacccaaggtagaacaaccgctgattttagccctcgtagcgacatggaaaaggacttcctaagtatggatatgggtttgtttattaacaagtacggacttgaagattacggctttgagcacgttgtgtatggtgatgtttcaaaaaccacccttggtggtttacatctactaatttcgcaggtgcgtctggcctgtatgggtgtgcttaaaatagacgagtttgtgtctagtaatgatagcacgttaaagtcatgtactgttacatatgctgacaaccctagtagtaagatggtttgcacgtatatggatctcctgcttgacgattttgttagcattcttaaatctttggatttgagcgttgtatctaaggttcatgaagttatggttgattgtaaaatgtggaggtggatgttgtggtgtaaggatcataaactccagacattttatccacaacttcaagccagtgaatggaagtgtggttattccatgccttctatttacaagatacaacgtatgtgcttagaaccttgcaatctctataactatggtgctggtgttaagttacctgatggcattatgtttaacgtagttaaatacacacagctttgtcaatatctcaatagcaccacaatgtgtgtaccccatcacatgcgtgtgctacatcttggtgctggctccgataagggtgttgcacctggcacggctgtcttacgacgttggttgccactggatgccattatagttgacaatgatagtgtggattacgttagcgatgctgattatagtgttacaggagattgctctaccttatacctgtcagataagtttgacttagttatatctgatatgtatgatggtaagattaaaagttgtgatggggagaacgtgtctaaagaaggcttctttccctatattaatggtgttatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacaccatgcatgccaattatatcttctggcgtaattccacaattatgactatgtcttacaacagtgtgcttgatttaagcaagttcaattgtaagcataaggctacagttgttgttaatttaaaagactcatccattagtgatgttgtgttaggcttgttgaagaatggtaagttgctagtgcgtaataatgacgccatttgtggcttttctaatcatttggtcaacgtaaacaaatgaggtctttaatttacttctggttgctcttaccagtacttccaacactcagcctaccacaagatgtcactaggtgccagtctactactaactttaggcggttcttttcaaaatttaatgttcaggcacctgccgtcgtcgttttgggtggttacctacctagtatgaactcttctagctggtactgtggcacaggcattgaaactgctagtggcgttcatggtatttttctcagctacatcgattctggtcagggctttgagattggcatttcgcaagagccgtttgatcctagtggttaccagctttatttacataaggccactaatggtaacactaatgctattgcacgactgcgcatttgccagtttcccgataataaaacattgggccctactgttaatgatgttacaacaggtcgtaactgcctattcaacaaagccattccagcttatatgcgtgatggaaaagatattgttgtcggcataacatgggataatgatcgtgtcactgtttttgctgacaagatctatcatttttatcttaaaaatgattggtcccgcgttgcgacaagatgttacaatcgcagaagttgtgctatgcaatatgtttatacacctacctactacatgcttaatgttactagtgcaggtgaggatggcatttattatgaaccctgtacagctaattgcactggttacgctgccaatgtatttgccactgattccaatggccatataccagaaggttttagttttaataattggtttcttttatccaatgactccactttgttgcatggtaaagtggtttccaaccaacccttgttggtcaattgtcttttggccattcctaagatttatggactaggccaatttttctcattcaatcacacgatggatggcgtttgtaatggagctgctgtggatcgtgccccagaggctctgaggtttaatattaatgacacctccgtcattcttgctgaaggctcaattgtacttcatactgctttaggaacaaatctttcttttgtttgcagtaattcctcagatcctcatttagccatctttgccatacctctgggtgctactgaagtaccctactattgctttcttaaagtggatacttacaactccactgtttataaattcttggctgttttacctcctactgtcagggaaattgtcatcaccaagtatggtgatgtttatgtcaatgggtttggctatttgcatctcggtttgttggatgctgtcacaattaatttcactggtcatggcactgacgatgacgtttcaggtttctggaccatagcatcgactaattttgttgatgcactcatcgaggttcaaggaacttccattcagcgtattctttattgtgatgatcctgttagccaactcaagtgttctcaggttgcttttgaccttgacgatggtttttaccccatctcttctagaaaccttctgagtcacgaacagccaatttcttttgttactttgccatcatttaatgatcattcttttgttaatattactgtctctgcggcttttggtggtcttagtagtgccaatctcgttgcatctgacactactatcaatgggtttagttctttctgtgttgacactagacaatttaccattacactgttttataatgttacaaacagttatggttatgtgtctaaatcacaggatagtaattgtcctttcaccttgcaatctgttaatgattacctgtcttttagcaaattttgtgtttcaaccagccttttggctggtgcttgtaccatagatctttttggttaccctgcgttcggtagtggtgttaagttgacgtccctttattttcaattcacaaaaggtgagttgattactggcacgcctaaaccacttgaaggtatcacagacgtttcttttatgactctggatgtgtgtaccaagtatactatctatggctttaaaggtgagggtattattacccttacaaattctagcattttggcaggtgtttattatacatctgattctggacagttgttagcctttaagaatgtcactagtggtgctgtttattctgtcacgccatgttctttttcagagcaggctgcatatgttaatgatgatatagtgggtgttatttctagtttgtctaactccacttttaacaatactagggagttgcctggtttcttctaccattctaatgacggctccaattgtacagagcctgtgttggtgtatagtaacataggtgtttgtaaatctggcagtattggctatgttccatctcagtatggccaagtcaagattgcacccacggttactgggaatattagtattcccaccaactttagtatgagtattagaacagaatatttacagctttacaacacgcctgttagtgttgattgtgctacatatgtttgtaatggtaactctcgttgtaaacaattactcacccagtacactgcagcatgtaagaccatagagtcagcattacaactcagcgctaggcttgagtctgttgaagttaactctatgcttaccatttctgaagaggctttacagttagctaccatcagttcgtttaatggtgatggatataactttactaatgtgctgggtgcttccgtgtacgatcctgcaagtggcagggtggtacaaaaaaggtctgttattgaagacttgctttttaataaagtggttactaatggccttggtactgttgatgaagactataagcgctgttctaatggtcgctctgtggctgatctagtctgtgcgcagtattactctggtgtcatggtactacctggcgttgttgacgctgagaagcttcacatgtacagtgcgtctctcataggtggtatggcgctaggaggtataactgctgcagcggcattgccttttagctatgctgttcaagcgagactcaattatcttgctttacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaattcgcagggttcagctttgaaccaacttaccgtacagctgcaacacaacttccaagccatttctagttctattgatgacatttattcccgactggacattctttcagccgatgttcaggttgatcgtctcatcaccggcagattatcagcacttaatgcttttgttgcccaaaccctcactaagtatactgaggttcaggctagcaggaagctagcacagcaaaaggttaatgagtgcgtcaaatcgcaatctcagcgttacggtttttgtggtggtgatggcgagcacattttctctctggtacaggccgcacctcagggcctgctgttcttacatacagtacttgtaccgggtgattttgtaaatgttcttgccatcgctggcttatgcgttaatggtgaaattgccttgactctacgtgagcctggcttagtcttgtttacgcatgaacttcaaacttatactgcgacggaatattttgtttcatcgcgacgtatgtttgaacctagaaaacctaccgttagtgattttgttcaaattgagagttgtgtggtcacctatgtcaatctgactagcgaccagctaccagatgtaatcccagattacatcgatgttaacaaaacacttgatgagattttagcttctctgcccaatagaactggtccaagtcttcccctagatgtttttaatgccacttatcttaatcttactggtgaaattgcagatctagagcagcgttcagagtctctccgtaatactacagaagagctccgaagtctcattaacaacatcaacaacacacttgttgaccttgagtggctcaaccgagttgagacatacatcaagtggccgtggtgggtttggttgatcattgttattgttctcatctttgttgtgtcattactagtgttctgctgcatttccacgggttgttgtggatgctgcggttgctgcggtgcttgtttttcaggttgttgtaggggtcctagacttcaaccttacgaagcttttgaaaaggtccacgtgcagtgatgtttcttggactttttcaatacacgattgacacagttgtcaaagatgtctcgaagtctgtcaacttgtctttggatgctgtccaagagttggagctcaatgtagttccaattagacaagcttcaaatgtgacgggttttcttttcaccagtgtttttgtttacttctttgcactgtttaaagcgtcttctttgaggcgcaattatattatgttggcagcgcgttttgctgtcgtctttctctattgcccacttttatattactgtggtgcacttttagatgcaactattatttgttgcgcacttattggcaggctttgtttagtctgcttttactcctggcgctataaaaatgcgctttttattatctttaatactacgacactttcttttctcaatggtaaagcagcttattatgacggcaaatccattgtgattctagaaggtggcgaccattacatcacttttggcaactcttttgttgctttcgttagtaacattgacttgtatctagctatacgtgggcggcaagaagctgacctacatctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattaccttcgtccaattggttaatctgtgcttcacttgtcaccggttgtgtaatagcgcagtttatacacctatagggcgcctgtatagagtttataagtcttacatgcgaattgaccccctccccagtactgttattgacgtataaacgaaatatgtctaacggttctattcccgttgatgaggtgattgaacaccttagaaactggaatttcacatggaatatcatactgacgatactacttgtagtgcttcagtatggccattacaagtactctgtgttcttgtatggtgtcaagatggctattctatggatactttggcctcttgtgttggcactgtcactttttgacgcatgggctagcttccaggtcaactgggtctttttcgctttcagcatccttatggcttgcatcactcttatgctgtggataatgtattttgtcaatagcattcggttgtggcgcaggacacattcttggtggtctttcaatcctgaaactgacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtcaaaacacggcgactattcagctgtgagtaatccgagtgcggttctcacagatagtgagaaagtgcttcatttagtctaaacagaaactttatggcttctgtcagctttcaggatcgtggccgcaaacgggtgccattatctctctatgcccctcttagggttactaatgacaagcccctttctaaggtacttgcaaacaacgctgtacccactaacaaggggaataaggaccagcaaattgggtactggaatgagcaaattcgctggcgcatgcgccgtggtgagcgaattgaacaaccttccaattggcatttctactacctcggaacaggacctcacggcgacctccgttataggactcgtactgagggtgttttctgggttgctaaagaaggcgcaaagactgaacccactaatttgggtgtcagaaaggcgtctgaaaagccaatcattccaaaattctctcaacagctccccagtgtagttgagattgttgaacctaacacacctcctgcttcacgtgcaaattcgcgtagcaggagtcgtggcaatggcaacaataggtctagatctccaagtaacaacagaggcaataaccagtcccgtggtaattcacagaatcgtggaaataaccagggtcgtggagcttctcagaacagaggaggcaataataataacaataacaagtctcgtaaccagtccaataacaggaaccagtcaaatgaccgtggtggtgtaacatcacgcgatgatctggtggctgctgtcaaggatgcacttaaatctttgggtattggagaaaatcctgacaggcataagcaacagcagaagcctaagcaggaaaagtctgacaacagcggcaaaaatacacctaagaagaacaaatccagggccacttcgaaggaacgtgacctcaaagacatcccagagtggaggagaattcccaagggcgaaaatagcgtagcagcttgcttcggacccagagggggcttcaaaaactttggagatgcggaatttgtcgaaaaaggtgttgatgcgtcaggctatgctcagatcgccagtttagcaccaaatgttgcagcattgctctttggtggtaatgtggctgttcgtgagctagcggactcttacgagattacatacaactataaaatgactgtgccaaagtcagatccaaatgttgagcttcttgtttcacaggtggatgcatttaaaactgggaatgcaaaactccagagaaagaaggaaaagaagaacaagcgtgaaaccacgctgcagcagcatgaagaggccatctacgatgatgtgggtgcgccatctgatgtgacccatgccaatctggaatgggacacagctgttgatggtggtgatacggccgttgaaattatcaacgagatcttcgatacaggaaattaaacaatgttagaccggcttatcctggctatgttccagggtagtgccattacactgttattactgagtgtttttctagcgacttggctgctgggctatggctttgccctctaaccagcggtcttggtcttgcacacaacggtaagccagtggtaatgtcagtgcaagaaggatattaccatagcactgtcacgaggggaacgcagtaccttttcatctaaacctttgcacgagtaattaaagatccgcttgacgagcctatatggaagagcgtgccaggtatttgacttaaggactgttagtaactgaagacctgacggtgttgatatggatacac

SEQ ID NO: 43 - DNA, 28033 bp, Coronavirus; identical to SEQ ID NO: 42

SEQ ID NO: 44 - DNA, 922 bp, Coronavirus
atttaataaatttggaaaagccaggctctattatgaagcattatcatttgaggagcaggatgaaatttacgcttatactaagcgcaatgtcctgccaacacttactcaaatgaatttgaaatatgctattagtgccaagaatagagcccgcactgttgctggtgtttccatacttagtactatgactggcagaatgtttcatcaaaaatgcttgaaaagtatagcagctacacgtggcgttcctgtggttataggcaccactaaattttatggcggctgggatgatatgttacgccgccttattaaagatgttgataatcctgtacttatgggttgggattatccaaagtgtgatcgtgctatgccaaacatactacgtattgttagtagtctggtattggcccgaaaacatgaggcatgttgttcgcaaagcgataggttttatcgactcgcgaatgaatgcgcacaagttcttagtgaaattgttatgtgtggtggctgttattatgttaagcctggtggcactagtagtggtgatgcaactactgcttttgctaattcagtctttaacatatgtcaagctgtttcagccaatgtatgtgccttaatgtcatgcaatggcaataagattgaagatttgagtatacgtgctcttcagaagcgcttatactcacatgtgtatagaaatgatatggttgattcaacctttgtcacagaatattatgaatttttaaataagcattttagtatgatgattttgagtgatgatggtgttgtgtgttatgattctgattatgcgtccaaagggtatattgctaatataagtgcttttcaacaggtattatattatcaaaataacgtttttatgtcagaatccaaatgttgggttgaaaatgacataaataaaggacctcatgaattc

SEQ ID NO: 45 - DNA, 922 bp, Coronavirus
atttaataaatttggaaaggccagactctactatgaagcattatcatttgaggagcaggacgaaatttatgcgtatactaaacgcaatgtcctgccgaccttaactcaaatgaatcttaaatatgctattagtgctaagaatagagcccgcactgttgctggtgtctccatccttagtactatgactggcagaatgtttcatcaaaagtgtttaaagagtatagcagctactcgtggtgtgcctgtagttataggcaccacgaagttttatggcggttgggatgacatgttacgccgccttattaaagatgttgatagtcctgtacttatgggttgggactatcctaagtgtgatcgtgctatgccaaacatactacgtattgttagtagtttggtgttagcccgtaaacatgattcgtgctgttcgcatacagatagattctatcgtcttgcgaacgagtgcgcccaagttttgagtgaaattgttatgtgtggtggttgttattatgttaaacctggtggcactagcagtggggatgcaaccactgcttttgctaattctgtttttaacatttgtcaagctgtttccgccaatgtatgctcgcttatggcatgcaatggacacaaaattgaagatttgagtatacgcgagttgcaaaagcgcctatactctaatgtgtatcgtgcggaccatgttgaccccgcatttgttagtgagtattatgagtttttaaataagcattttagtatgatgattttgagtgatgatggtgttgtgtgttataattcagagtttgcgtccaagggttatattgctaatataagtgcctttcaacaggtattatattatcaaaataatgtgtttatgtctgaggccaaatgttgggtcgaaacggacattgaaaagggaccgcatgaattt

SEQ ID NO: 46 - DNA, 28920 bp, Coronavirus
  misc_feature 7230-7329, 9929-10028, 10137-10236, 11646-11745, 20385-20484,21024-21123, 21753-21852, 22112-22211, 25301-25400: n = A,T,C or G
ttattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcattcccgtcaggcaaagttgaagggtgcatggtacaagtaacctgtggaactacaactcttaatggattgtggttggatgacacagtatactgtccaagacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagc

SEQ ID NO: 47 - DNA, 29725 bp, Coronavirus
ccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccattacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataaccttaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatcccagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatcccatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaa

SEQ ID NO: 48 - DNA, 29745 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggataagtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactgttaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccattacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagaccaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagactttaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgttatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacctgagagttattcactttggtgctggctctgataaaggagttgcaccaggtacagctgtgctcagacaatggttgcccactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacaaacatgtttattttcttattatttcttactctcactagtggtagtgaccttgaccggtgcaccacttttgatgatgttcaagctcctaattacactcaacatacttcatctatgaggggggtttactatcctgatgaaatttttagatccgacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaagagatgttgtgagattccctaatattacaaacttgtgtccttttggagaggtttttaatgctactaaattcccttctgtctatgcatgggagaggaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttgaatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagatccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaa

SEQ ID NO: 49 - DNA, 29430 bp, Coronavirus
  misc_feature 6464-6563, 11343-11442, 22567-22666: n = A,T,C or G
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagagggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggataagtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaggtacattcttatgtgcgaatgagtacactggtaactatcagtgtggtcattacactcatataactgctaaggagaccctctatcgtattgacggagctcaccttacaaagatgtcagagtaccaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccattacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagaccaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtaaactttaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttatacccaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtcccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttgggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtcctttgggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttgaatcaattactgcacagccagtaaaaattgacaatgcttctcctgcaagtactgttcatgctacagcaacgataccgctacaagcctcactccctttcggagtggcttgttattggcgttgcatttcttgctgtttttcacgagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagatccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagaccaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatg

SEQ ID NO: 50 - DNA, 29291 bp, Coronavirus
  misc_feature 6112, 10070-10169, 10560, 10775, 10849-10948, 21378-21477, 22501,23795-23894, 25144-25243, 26737, 26823-26922, 28128, 28463,: n = A,T,C or G
tagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccnattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttgctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagttcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgaaaccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttnttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacnggaattgccgtcttagatatgtgtgctgctttgaaagagctgctgcagaatggtatgaatggtcgtactatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggtaagttcaagaaaattgttaagggcactcatcattggatgcttttaactttcttgacatcactattgattcttgttcaaagtacacagtggtcactgtttttcttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatataaactcccagggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactagctctcgcgattcttcaaggcaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatgtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaatttggctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctattgacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactaacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatttattttgctgccacagagaaatcaaatgtgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggttttttatgctactaaattcccttctgtctatgcatgggagagaaaaaaaatttctaattgtgttgctgagttactctgtgctctacaactcaacatttttttcaacctttaagtgctatggcgtttctgccactaagttgaatgatctttgcttctccaaagtctatgcagattcttttgtagtcaagggagatgatgtaagacaaatagcgccaggacaaactggtgttattgctgattataattataaattgccagatgatttcatgggttgtgtccttgcttggaatactaggnacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgtnataataagttcaatagtgagacaattatttaagcctctaactaagaagaattattcggagttagatgatgaagaacttatggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctnacaaagaaggcatcgtatgggttgcaactgagggagccttgaatacacccaaagaccacattggcacccgcaatcctaataacaatgctgccaccgtgctacaacttcctcaaggaacaacattgcctaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtanaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccc

SEQ ID NO: 51 - DNA, 29740 bp, Coronavirus
taggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttcatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgccaagcgagttcttaatgtggtgtgtaaacattgtggtcagaaaactactaccttaacgggtgtagaagctgtgatgtatatgggtactctatcttatgataatcttaagacaggtgtttcccttccatgtgtgtgtggtcgtgatgctacacaatatctagtaccaccagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtaaacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctattgacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactacccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccctgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctacttcgtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttgaatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatcccatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaattacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaa

SEQ ID NO: 52 - DNA, 29732 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtacccttttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaaatactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagtcttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgaaatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaccattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagaccatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaccaaattgatggctataccatgcatgctaactacattttctggaggaacacaaatcctatccagttgtcttcctattcactctttgacatgagccaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttcccttttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcatggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaa

SEQ ID NO: 53 - DNA, 24774 bp, Coronavirus
  misc_feature 860-959, 2089-2188, 2478-2577, 2877-2976, 3576-3675, 3865-3964,4134-4233, 4563-4662, 5012-5111, 5781-5879, 7438-7537, 7837-7936,8616-8715, 12025-12124, 13984-14083, 16463-16562, 16932-17031,17381-17480, 18090-18189, 19019-19118, 19478-19577, 20357-20456,21086-21185, 21945-22044, 23174-23273, 23531: n = A,T,C or G
actttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttaaatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcactccctttcggatggcttgttattggcgttgcatttcttgctgtttttcagagcgctaccaataataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcnaaatgaaagagctcagccccagatggtacttctattacctaggaactggcccagaagcttcacttccctacggcgctnacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccct

SEQ ID NO: 54 - DNA, 29736 bp, Coronavirus
ctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgtttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgctgtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 55 - DNA, 29736 bp, Coronavirus
ctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatcctctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggcaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgtttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 56 - DNA, 29206 bp, Coronavirus
aaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatcctctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggcaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgtttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaa

SEQ ID NO: 57 - DNA, 29740 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaaacactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactattatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgattttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaa

SEQ ID NO: 58 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaaacactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactattatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgattttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatattgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 59 - DNA, 29757 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcactgccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagagagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgcagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacaccttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaggactgctcttaagaaatgcaaatctgcatcttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttaaccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaatttttgcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctatgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagttcccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttacatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgttgagagcaatcaatggtgacttcttgcattttctacctcgtgtttttagtgctgttggcaacatttgctacacaccttccaaactcattgagtatagtgattttgctacctctgcttgcgttcttgctgcagagtgtacaatttttaaggatgctatgggcaaacctgtgccatattgttatgacactaatttgctagagggttctatttcttatagtgagcttcgtccagacactcgttatgtgcttatggatggttccatcatacagtttcctaacatttacctggagggttctgttagagtagtaacaacttttgatgctgagtactgtagacatggtacatgcgaaaggtcagaagcaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggcaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaaggatgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcggttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataaccttaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaacgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcatcaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttatcctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtgtctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttaatgacttcgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgaattcgtctccgacgcagattctactttaattggagactgtgcaacagtacatacggctaataaatgggaccttatcattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaagacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaataactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttgacaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacccatttttaagttgcctcttggtattaacattacaaattttagagccattcttacagcctttttacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaagagatgttgtgagattccctaatattacaaacttgtgtccttttggagaggtttttaatgctactaaattcccttctgtctatgcatgggagaggaaaagaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttatgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaagattttggtggttttaatttttcacaaatattacctgaccctctaaagtcaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgcggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgcaggtgacggcatttcaacaccaaaactcaaagaagactaccaaattggtggttattctgaggattggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgcaaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcatggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacttatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtcctactggttaccaacctgaatggaatataaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtatttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaa

SEQ ID NO: 60 - DNA, 29429 bp, Coronavirus
  misc_feature 860-959, 2509-2608, 3338-3437, 5551, 5767-5866, 7296-7395, 8908,10914-11014, 11744-11843, 14993-15092, 20606, 20953, 21432-21531,25728, 25746, 26631-26730, 28364,: n = A,T,C or G
cccctttattttcgcaaccagctcaacatcatctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgttcctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcactgccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaacatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattaaatgtgctgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacaccttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaggactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagattgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcnaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaatttttgcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctatgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttggtttaaacttatgcttaaggccacattattgtgcgttcttgctgcattggtttgttacatcgttatgccattacatactttgtcaatccatgatggttacacaaatgaaatcattggttacaaagccattcaggatggtgtcactcgtgacatcatttctactgatgattgttttgcaaataaacatgctggttttgacgcactggtttagccagcgtggtggttcatacaaaaatgacaaaagctgccctgtagtagctgctatcattacaagagagattggtttcatagtgcctggcttaccgggtactgtgntgagagcaatcaatggtgacttcttgcattttctacctcgtgtttttagtgctgttggcaacatttgctacacaccttccaaactcattgagtatagtgattttgctacctctgcttgcgttcttgctagcagagtgtacaatttttaaggatgctatgggcaaacctgtgccatattgttatgacactaatttgctagagggttctatttcttatagtgagcttcgtccagacactcgttatgtgcttatggatggttccatcatacagtttcctaacatttacctggagggttctgttagagtagtaacaacttttgatgctgagtactgtagacatggtacatgcgaaaggtcagaagcaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgcttttggtgagtacaaccatgttgttgctgctaatgcacttttgtttttgatgtctttcactatactctgtctggcaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaaggatgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaaaattgttaagggcactcatcattggatgcttttaactttcttgacatcactattgattcttgttcaaagtacacagtggtcactgtttttcttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgccagggtgctgtagacattaataggttgtgcgaggaaatgctcgataaccgtgctactcttcagggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaattacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtggggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcaattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcatcaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggagaagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttatcctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgattncaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtnctcagacaatggttgccaactggcacactacttgtcgattcagatcttaatgacttcgtctccgacgcagattctactttaattggagactgtgcaacagtacatacggctaataaatgggaccttattattagcgatatgtatgaccctaagaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacccatttttaagttgcctcttggtattaacattacaaattttagagccattcttacagcctttttacctgctcaagacacttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaagagatgttgtgagattccctaatattacaaacttgtgtccttttggagaggtttttaatgctactaaattcccttctgtctatgcatgggagaggaaaagaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaagattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgcggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaagaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgagcaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtagcctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgcaggtgacggcatttcaacaccaaaactcaaagaagactaccaaattggtggttattctgaggattggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgcnaatccagcaatggatccnatttatgatgagccgacgacgactactagcgtgcctttgtaagcacaagaaagtgagtacgaacttatgtactcattcgtttcggaagaaacaggtacgttaatagttaatagcgtacttctttttcttgctttcatggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgctttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatacgcactgtagtacagcgctgtgcatctaataaacctcatgtgcttgaagatccttgtcctactggttaccaacctgaatggaatataaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagcctaggtgttggtaccttcatgaaggtcaccaaactgctgcatttagagacgtatttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaatnacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagaccaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgc

SEQ ID NO: 61 - DNA, 29742 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgtcggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcaaacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtactgctgccaagaagaacaacataccttttacactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaaagtgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaaattcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtaaggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaa

SEQ ID NO: 62 - DNA, 29751 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttarattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 63 - DNA, 29751 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcaaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttarattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 64 - DNA, 10546 bp, Coronavirus
agtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtaccgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcccaagtcgcttctgctatgcaaacaatgctcttcactatgctaaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggac

SEQ ID NO: 65 - DNA, 29711 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgagaagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 66 - DNA, 29705 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactaggtgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagggatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 67 - DNA, 29711 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacatacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattctgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 68 - DNA, 29706 bp, Coronavirus
  misc_feature 20688: n = A,T,C or G
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaagnaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtattttgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 69 - DNA, 29711 bp, Coronavirus
tacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacataggaaatccaaaggctatcaagtgtgtgcctcaggctgaagtagaatggaagttctacgatgctcagccatgtagtgacaaagcttacaaaatagaggaactcttctattcttatgctatacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagttaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 70 - DNA, 29573 bp, Coronavirus
aactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagct

SEQ ID NO: 71 - DNA, 29573 bp, Coronavirus
aactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagttcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtcttaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacatactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagct

SEQ ID NO: 72 - DNA, 29573 bp, Coronavirus
aactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattacttgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagct

SEQ ID NO: 73 - DNA, 29751 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgcgcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttagatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 74 - DNA, 29736 bp, Coronavirus
ctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgcgcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttagatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 75 - DNA, 29736 bp, Coronavirus
ctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgtcggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcgagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcatattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgcgcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaaaaaaaaaaaaaaaaaaaaaaaa

SEQ ID NO: 76 - DNA, 29729 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcggctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaa

SEQ ID NO: 77 - DNA, 29725 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccgggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgttgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 78 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgtggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 79 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 80 - DNA, 29727 bp, Coronavirus; identical to SEQ ID NO: 78

SEQ ID NO: 81 - DNA, 29725 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgactatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttaataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 82 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggttttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggtaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 83 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattatactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 84 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatccgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattatccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgatcaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagttacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctatgcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctttatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 85 - DNA, 29751 bp, Coronavirus; identical to SEQ ID NO: 73

SEQ ID NO: 86 - DNA, 29727 bp, Coronavirus
atattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctactttgacaaggctggtcaaaagacctatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagttcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcaactgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatcaacgtttttaaacgggtttgcggtgtaagtgcagcccgtcttacaccgtgcggcacaggcactagtactgatgtcgtctacagggcttttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgtacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgctactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggagctcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagctcgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacaccccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgac

SEQ ID NO: 87 - DNA, 29715 bp, Coronavirus
cctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgtgcattaaacgttctgatgcctaaagcacctatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgaaattaagagtgccaagaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtmaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgctgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtacttacctctgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaacaagaggagccaccaaacacagaagattccaaaactgaggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggtgatatcacttgtgttgtaataccctccaaaaaggctggtggcactactgagatgctctcaagagctttgaagaaagtgccagttgatgagtatataaccacgtaccctggacaaggatgtgctggttatacacttgaggaagctaagactgctcttaagaaatgcaaatctgcattttatgtactaccttcagaagcacctaatgctaaggaagagattctaggaactgtatcctggaatttgagagaaatgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgtgtaccacactctggagagccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggacagcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggagttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcacattcttcccagacttgaatggcgatgtagtggctattgactatagacactattcagcgagtttcaagaaaggtgctaaattactgcataagccaattgtttggcacattaaccaggctacaaccaagacaacgttcaaaccaaacacttggtgtttacgttgtctttggagtacaaagccagtagatacttcaaattcatttgaagttctggcagtagaagacacacaaggaatggacaatcttgcttgtgaaagtcaacaacccacctctgaagaagtagtggaaaatcctaccatacagaaggaagtcatagagtgtgacgtgaaaactaccgaagttgtaggcaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcaattaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactactatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaggatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccatactgaccagtcatcgtatatagttgatagtgttgctgtgaaaaatggcgcgcttcacatctactttgacaaggctggtcaaaagacatatgagagacatccgctctcccattttgtcaatttagacaatttgagagctaacaacactaaaggttcactgcctattaatgtcatagtttttgatggcaagtccaaatgcgacgagtctgcttctaagtctgcttctgtgtactacagtcagctgatgtgccaacctattctgttgcttgaccaagctcttgtatcagacgttggagatagtactgaagtttccgttaagatgtttgatgcttatgtcgacaccttttcagcaacttttagtgttcctatggaaaaacttaaggcacttgttgctacagctcacagcgagttagcaaagggtgtagctttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcacctataataaggttgaaaacatgacgcccagagatcttggcgcatgtattgactgtaatgcaaggcatatcaatgcccaagtagcaaaaagtcacaatgtttcactcatctggaatgtaaaagactacatgtctttatctgaacagctgcgtaaacaaattcgtagtgctgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatacgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgctctagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcctaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaaattctatggtccatttgttgacagacaaactgcacaggctgcaggtacagacacaaccataacattaaatgttttggcatggctgtatgctgctgttatcaatggtgataggtggtttcttaatagattcaccactactttgaatgactttaaccttgtggcaatgaagtacaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccatttactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactatcatgtttttagctagagctatagtgtttgtgtgtgttgagtataacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaacattaagttgttgggtattggaggtaaaccatgtatcaaggttgctactgtacagtctaaaatgtctgacgtaaagtgcacatctgtggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagcatgttcaacttagtgaaattaacatggacaattcaccaaatttggcttggcctcttattgttacagctctaagagccaactcagctgttaaactacagaataatgaactgagtccagtagcactacgacagatgtcctgtgcggctggtaccacacaaacagcttgtactgatgacaatgcacttgcctactataacaattcgaagggaggtaggtttgtgctggcattactatcagaccaccaagatctcaaatgggctagattccctaagagtgatggtacaggtacaatttacacagaactggaaccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgcccattcagactgtgatttccttctgtgcttttgcagtagaccctggtcaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtggaaaggttatggctgtagttgtgaccaactccgcgaacccttgatgcagtctgcggatgcatctaacgtttttaaacgggtttgcggtgtaagtgcagcccgtcttacaccgtgcggcacaggcactagtactgatgtctgtctacagggcattttgatatttacaacgaaaaagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaagactgtacaattctgcgatgctatgcgtgatgcaggcattgtaggcgtactgacattagataatcaggatcttaatgggaactggtacgatttcggtgatttcgaacaagtagcaccaggctgcggagttcctattgtggattcatattactcattgctgatgcccatcctcactttgactagggcattggctgctgagtcccatatggatgctgatctcgcaaaaccacttattaagtgggatttgctgaaatatgattttacggaagagagactttgtctcttcgaccgttattttaaatattgggaccagacataccatcccaattgtattaactgtttggatgataggtgtatccttcattgtgcaaactttaatgtgttattttctactgtgtttccacctacaagttttggaccactagtaagaaaaatatttgtagatggtgttccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgttacgatggtggctgtattaatgccaaccaagtaatcgttaacaatctggataaatcagctggtttcccatttaataaatggggtaaggctagactttattatgactcaatgagttatgaggatcaagatgcacttttcgcgtatactaagcgtaatgtcatccctactataactctaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcatctacaacacaggctctatgagtgtctctatatgaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgaccttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccaggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaatagtaaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgctgttgtcctgctgaaattgttgacactgtgagtgctttagtatatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggtactaacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttaagcgcgttgattggtctgttgaataccctattataggagatgaactgagggttaattctgcttgcagaaaagtacaacacatggttgtgaagtctgcattgcttgctgataagtttccagttcttcatgacattggaaatccaaaggctatcaagtgtgtgcctcaggctgaagtagaatggaagttctacgatgctcagccatgtagtgacaaagcttacaaaatagaggaactcttctattcttatgctacacatcacgataaattcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgatttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctgttaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggttcagtcaaaggtctaacaccttcaaagggaccagcacaagctagcgtcaatggagtcacattaattggagaatcagtaaaaacacagtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagaattatggtgaaaatgctgttataccaaaaggaataatgatgaatgtcgcaaagtatactcaactgtgtcaatacttaaatacacttactttagctgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatcttggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcaccacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgttatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttatgagattttttactcttggatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagcttgagtctacacaaattactacagacactggtattgaaaatgctacattcttcatctttaacaagcttgttaaagacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgtgttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccagagatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccgaagcttcacttccctacggcgctaacaaagaaggcatcgtatgggttgcaactgagggagcctgaaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaaattcaactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaat

SEQ ID NO: 88 - DNA, 29749 bp, Coronavirus
ttattaggtttttacctacccaggaaaagccaaccaacctcgatctcttgtagatctgttctctaaacgaactttaaaatctgtgtagctgtcgctcggctgcatgcctagtgcacctacgcagtataaacaataataaattttactgtcgttgacaagaaacgagtaactcgtccctcttctgcagactgcttacggtttcgtccgtgttgcagtcgatcatcagcatacctaggtttcgtccgggtgtgaccgaaaggtaagatggagagccttgttcttggtgtcaacgagaaaacacacgtccaactcagtttgcctgtccttcaggttagagacgtgctagtgcgtggcttcggggactctgtggaagaggccctatcggaggcacgtgaacacctcaaaaatggcacttgtggtctagtagagctggaaaaaggcgtactgccccagcttgaacagccctatgtgttcattaaacgttctgatgccttaagcaccaatcacggccacaaggtcgttgagctggttgcagaaatggacggcattcagtacggtcgtagcggtataacactgggagtactcgtgccacatgtgggcgaaaccccaattgcataccgcaatgttcttcttcgtaagaacggtaataagggagccggtggtcatagctatggcatcgatctaaagtcttatgacttaggtgacgagcttggcactgatcccattgaagattatgaacaaaactggaacactaagcatggcagtggtgcactccgtgaactcactcgtgagctcaatggaggtgcagtcactcgctatgtcgacaacaatttctgtggcccagatgggtaccctcttgattgcatcaaagattttctcgcacgcgcgggcaagtcaatgtgcactctttccgaacaacttgattacatcgagtcgaagagaggtgtctactgctgccgtgaccatgagcatgaaattgcctggttcactgagcgctctgataagagctacgagcaccagacacccttcgcaaattaagaagtgccaagaaaatttgacactttcaaaggggaatgcccaaagtttgtgtttcctcttaactcaaaagtcaaagtcattcaaccacgtgttgaaaagaaaaagactgagggtttcatggggcgtatacgctctgtgtaccctgttgcatctccacaggagtgtaacaatatgcacttgtctaccttgatgaaatgtaatcattgcgatgaagtttcatggcagacgtgcgactttctgaaagccacttgtgaacattgtggcactgaaaatttagttattgaaggacctactacatgtgggtacctacctactaatgctgtagtgaaaatgccatgtcctgcctgtcaagacccagagattggacctgagcatagtgttgcagattatcacaaccactcaaacattgaaactcgactccgcaagggaggtaggactagatgttttggaggctgtgtgtttgcctatgttggctgctataataagcgtgcctactgggttcctcgtgctagtgttgatattggctcaggccatactggcattactggtgacaatgtggagaccttgaatgaggatctccttgagatactgagtcgtgaacgtgttaacattaacattgttggcgattttcatttgaatgaagaggttgccatcattttggcatctttctctgcttctacaagtgcctttattgacactataaagagtcttgattacaagtctttcaaaaccattgttgagtcctgcggtaactataaagttaccaagggaaagcccgtaaaaggtgcttggaacattggacaacagagatcagttttaacaccactgtgtggttttccctcacaggctgctggtgttatcagatcaatttttgcgcgcacacttgatgcagcaaaccactcaattcctgatttgcaaagagcagctgtcaccatacttgatggtatttctgaacagtcattacgtcttgtcgacgccatggtttatacttcagacctgctcaccaacagtgtcattattatggcatatgtaactggtggtcttgtacaacagacttctcagtggttgtctaatcttttgggcactactgttgaaaaactcaggcctatctttgaatggattgaggcgaaacttagtgcaggagttgaatttctcaaggatgcttgggagattctcaaatttctcattacaggtgtttttgacatcgtcaagggtcaaatacaggttgcttcagataacatcaaggattgtgtaaaatgcttcattgatgttgttaacaaggcactcgaaatgtgcattgatcaagtcactatcgctggcgcaaagttgcgatcactcaacttaggtgaagtcttcatcgctcaaagcaagggactttaccgtcagtgtatacgtggcaaggagcagctgcaactactcatgcctcttaaggcaccaaaagaagtaacctttcttgaaggtgattcacatgacacagtactttacctcttgaggaggttgttctcaagaacggtgaactcgaagcactcgagacgcccgttgatagcttcacaaatggagctatcgttggcacaccagtctgtgtaaatggcctcatgctcttagagattaaggacaaagaacaatactgcgcattgtctcctggtttactggctacaaacaatgtctttcgcttaaaagggggtgcaccaattaaaggtgtaacctttggagaagatactgtttgggaagttcaaggttacaagaatgtgagaatcacatttgagcttgatgaacgtgttgacaaagtgcttaatgaaaagtgctctgtctacactgttgaatccggtaccgaagttactgagtttgcatgtgttgtagcagaggctgttgtgaagactttacaaccagtttctgatctccttaccaacatgggtattgatcttgatgagtggagtgtagctacattctacttatttgatgatgctggtgaagaaaacttttcatcacgtatgtattgttccttttaccctccagatgaggaagaagaggacgatgcagagtgtgaggaagaagaaattgatgaaacctgtgaacatgagtacggtacagaggatgattatcaaggtctccctctggaatttggtgcctcagctgaaacagttcgagttgaggaagaagaagaggaagactggctggatgatactactgagcaatcagagattgagccagaaccagaacctacacctgaagaaccagttaatcagtttactggttatttaaaacttactgacaatgttgccattaaatgtgttgacatcgttaaggaggcacaaagtgctaatcctatggtgattgtaaatgctgctaacatacacctgaaacatggtggtggtgtagcaggtgcactcaacaaggcaaccaatggtgccatgcaaaaggagagtgatgattacattaagctaaatggccctcttacagtaggagggtcttgtttgctttctggacataatcttgctaagaagtgtctgcatgttgttggacctaacctaaatgcaggtgaggacatccagcttcttaaggcagcatatgaaaatttcaattcacaggacatcttacttgcaccattgttgtcagcaggcatatttggtgctaaaccacttcagtctttacaagtgtgcgtgcagacggttcgtacacaggtttatattgcagtcaatgacaaagctctttatgagcaggttgtcatggattatcttgataacctgaagcctagagtggaagcacctaaaccagaggagccaccaaacacagaagattccaaaactgagggagaaatctgtcgtacagaagcctgtcgatgtgaagccaaaaattaaggcctgcattgatgaggttaccacaacactggaagaaactaagtttcttaccaataagttactcttgtttgctgatatcaatggtaagctttaccatgattctcagaacatgcttagaggtgaagatatgtctttccttgagaaggatgcaccttacatggtaggtgatgttatcactagtggcgatatcacttgtgttgtaataccctccaaaaaggctggtggcactactgagatgctctcaagagctttgaagaaagtgccagttgatgagtatataaccacgtaccctggacaaggatgtgctggttatacacttgagggaagctaagactgctcttaagaaatgcaaatctgcattttatgtactaccttcagaagcacctaatgctaaggaagagattctaggaactgtatcctggaatttgagagaagtgcttgctcatgctgaagagacaagaaaattaatgcctatatgcatggatgttagagccataatggcaaccatccaacgtaagtataaaggaattaaaattcaagagggcatcgttgactatggtgtccgattcttcttttatactagtaaagagcctgtagcttctattattacgaagctgaactctctaaatgagccgcttgtcacaatgccaattggttatgtgacacatggttttaatcttgaagaggctgcgcgctgtatgcgttctcttaaagctcctgccgtagtgtcagtatcatcaccagatgctgttactacatataatggatacctcacttcgtcatcaaagacatctgaggagcactttgtagaaacagtttctttggctggctcttacagagattggtcctattcaggacagcgtacagagttaggtgttgaatttcttaagcgtggtgacaaaattgggtaccacactctggagagcccccgtcgagtttcatcttgacggtgaggttctttcacttgacaaactaaagagtctcttatccctgcgggaggttaagactataaaagtgttcacaactgtggacaacactaatctccacacacagcttgtggatatgtctatgacatatggactgcagtttggtccaacatacttggatggtgctgatgttacaaaaattaaacctcatgtaaatcatgagggtaagactttctttgtactacctagtgatgacacactacgtagtgaagctttcgagtactaccatactcttgatgagagttttcttggtaggtacatgtctgctttaaaccacacaaagaaatggaaatttcctcaagttggtggtttaacttcaattaaatgggctgataacaattgttatttgtctagtgttttattagcacttcaacagcttgaagtcaaattcaatgcaccagcacttcaagaggcttattatagagcccgtgctggtgatgctgctaacttttgtgcactcatactcgcttacagtaataaaactgttggcgagcttggtgatgtcagagaaactatgacccatcttctacagcatgctaatttggaatctgcaaagcgagttcttaatgtggtgtgtaaacattgtggtcagaaaactactaccttaacgggtgtagaagctgtgatgtatatgggtactctatcttatgataatcttaagacaggtgtttccattccatgtgtgtgtggtcgtgatgctacacaatatctagtacaacaagagtcttcttttgttatgatgtctgcaccacctgctgagtataaattacagcaaggtacattcttatgtgcgaatgagtacactggtaactatcagtgtggtcattacactcatataactgctaaggagaccctctatcgtattgacggagctcaccttacaaagatgtcagagtacaaaggaccagtgactgatgttttctacaaggaaacatcttacactacaaccatcaagcctgtgtcgtataaactcgatggtgttacttacacagagattgaaccaaaattggatgggtattataaaaaggataatgcttactatacagagcagcctatagaccttgtaccaactcaaccattaccaaatgcgagttttgataatttcaaactcacatgttctaacacaaaatttgctgatgatttaaatcaaatgacaggcttcacaaagccagcttcacgagagctatctgtcgcattcttcccagacttgaatggcgatgtagtggctattgactatagacactattcagcgagtttcaagaaaggtgctaaattactgcataggccaattgtttggcacattaacccggctacaaccaagacaacgttcaaaccaaacacttggtgtttacgttgtctttggagtacaaagccagtagatacttcaaattcatttgaagttctggcagtagaagacacacaaggaatggacaatctcgcttgtgaaagtcaacaaacccacctctgaagaagtagtggaaaatcctaccatacagaaggaagtcatagagtgtgacgtgaaaactaccgaagttgtaggcaaatgtcatacttaaaccatcagatgaaggtgttaaagtaacacaagagttaggtcatgaggatcttatggctgcttatgtggaaaacacaagcattaccattaagaaacctaatgagctttcactagccttaggtttaaaaacaattgccactcatggtattgctgcagttaatagtgttccttggagtaaaattttggcttatgtcaaaccattcttaggacaagcagcaattacaacatcaaattgcgctaagagattagcacaacgtgtgtttaacaattatatgccttatgtgtttacattattgttccaattgtgtacttttactaaaagtaccaattctagaattagagcttcactacctacaactattgctaaaaatagtgttaagagtgttgctaaattatgtttggatgccggcattaattatgtgaagtcacccaaattttctaaattgttcacaatcgctatgtggctattgttgttaagtatttgcttaggttctctaatctgtgtaactgctgcttttggtgtactcttatctaattttggtgctccttcttattgtaatggcgttagagaattgtatcttaattcgtctaacgttactgctatggatttctgtgaaggttcttttccttgcagcatttgtttaagtggattagactcccttgattcttatccagctcttgaaaccattcaggtgacgatttcatcgtacaagctagacttgacaattttaggtctggccgctgagtgggttttggcatatatgttgttcacaaaattcttttatttattaggtctttcagctataatgcaggtgttctttggctattttgctagtcatttcatcagcaattcttggctcatgtggtttatcattagtattgtacaaatggcacccgtttctgcaatggttaagatgtacatcttctttgcttctttctactacatatggaagagctatgttcatatcatggatggttgcacctcttcgacttgcatgatgtgctataagcgcaatcgtgccacacgcgttgagtgtacaactattgttaatggcatgaagagatctttctatgtctatgcaaatggaggccgtggcttctgcaagactcacaattggaattgtctcaattgtgacacattttgcactggtagtacattcattagtgatgaagttgctcgtgatttgtcactccagtttaaaagaccaatcaaccctactgaccagtcatcgtatattgttgatagtgttgctgtgaaaaatggcgcgcttcacctctacttcgacaaggctggtcaaaagacctatgagagacatccgctctcccattttgtcaatttagacaatttgagagctaacaaacactaaaggttcactgcctattaatgccatagtttttgatggcaagtccaaatacgacgagtctgcttctaagtctgcttctgtgtactacagtcagctgatgtgccaacctattctgttgcttgaccaagctcttgtatcagacgttggagatagtactgaagtttccgttaagatgtttgatgcttaagtcgacaccttttcagcaacttttagtgttcctatggaaaaacttaaggcacttgttgctacagctcacagcgagttagcaaagggtgtagcttttagatggtgtcctttctacattcgtgtcagctgcccgacaaggtgttgttgataccgatgttgacacaaaggatgttattgaatgtctcaaactttcacatcactctgacttagaagtgacaggtgacagttgtaacaatttcatgctcgcctataataaggttgaaaacatgacgcccagagatcttggcgcatgtattgactgtaatgcaaggcatatcaatgcccaagtagcaaaaagtcacaatgtttcactcatctggaatgtaaaagactacgtgtctttatctgaacagctgcgtaaacaaattcgtagtgccgccaagaagaacaacataccttttagactaacttgtgctacaactagacaggttgtcaatgtcataactactaaaatctcactcaagggtggtaagattgttagtacttgttttaaacttatgcttaaggccacattattgtgcgttcttgctgcattggtttgttatatcgttatgccagtacatacattgtcaatccatgatggttacacaaatgaaatcattggttacaaagccattcaggatggtgtcactcgtgacatcatttctactgatgattgttttgcaaataaacatgctggttttgacgcatggtttagccagcgtggtggttcatacaaaaatgacaaaagctgccctgtagtagctgctatcattacaagagagattggtttcatagtgcctggcttaccgggtactgtgctgagagcaatcaatggtgacttcttgcattttctacctcgtgtttttagtgctgttggcaacatttgctacacaccttccaaactcattgagtatagtgattttgctacctctgcttgcgttcttgctgctgagtgtacaatttttaaggatgctatgggcaaacctgtgccatattgttatgacactaatttgctagagggttctatttcttatagtgagcttcgtccagacactcgttatgtgcttatggatggttccatcatacagtttcctaacacttacctggagggttctgttagagtagtaacaacttttgatgctgagtactgtagacatggtacatgcgaaaggtcagaagtaggtatttgcctatctaccagtggtagatgggttcttaataatgagcattacagagctctatcaggagttttctgtggtgttgatgcgatgaatctcatagctaacatctttactcctcttgtgcaacctgtgggtgctttagatgtgtctgcttcagtagtggctggtggtattattgccatattggtgacttgtgctgcctactactttatgaaattcagacgtgtttttggtgagtacaaccatgttgttgctgctaatgcacttttgtttttgatgtctttcactatactctgtctggtaccagcttacagctttctgccgggagtctactcagtcttttacttgtacttgacattctatttcaccaatgatgtttcattcttggctcaccttcaatggtttgccatgttttctcctattgtgcctttttggataacagcaatctatgtattctgtatttctctgaagcactgccattggttctttaacaactatcttaggaaaagagtcatgtttaatggagttacatttagtaccttcgaggaggctgctttgtgtacctttttgctcaacaaggaaatgtacctaaaattgcgtagcgagacactgttgccacttacacagtataacaggtatcttgctctatataacaagtacaagtatttcagtggagccttagatactaccagctatcgtgaagcagcttgctgccacttagcaaaggctctaaatgactttagcaactcaggtgctgatgttctctaccaaccaccacagacatcaatcacttctgctgttctgcagagtggttttaggaaaatggcattcccgtcaggcaaagttgaagggtgcatggtacaagtaacctgtggaactacaactcttaatggattgtggttggatgacacagtatactgtccaagacatgtcatttgcacagcagaagacatgcttaatcttaactatgaagatctgctcattcgcaaatccaaccatagctttcttgttcaggctggcaatgttcaacttcgtgttattggccattctatgcaaaattgtctgcttaggcttaaagttgatacttctaaccctaagacacccaagtataaatttgtccgtatccaacctggtcaaacattttcagttctagcatgctacaatggttcaccatctggtgtttatcagtgtgccatgagacctaatcataccattaaaggttctttccttaatggatcatgtggtagtgttggttttaacattgattatgattgcgtgtctttctgctatatgcatcatatggagcttccaacaggagtacacgctggtactgacttagaaggtaagttctatggtccatttgttgacagacaaactgcacaggctgcaggtacagacacaaccataacataaatgtttggcatggctgtatgctgctgttatcaatggtgataggtggtttcttaatagattcaccactactttgaatgactttaaccttgtggcaatgaagtgcaactatgaacctttgacacaagatcatgttgacatattgggacctctttctgctcaaacaggaattgccgtcttagatatgtgtgctgctttgaaagagctgctgcagaatggtatgaatggtcgtactatccttggtagcactattttagaagatgagtttacaccatttgatgttgttagacaatgctctggtgttaccttccaaggtaagttcaagaaaattgttaagggcactcatcattggatgcttttaactttcttgacatcactattgattcttgttcaaagtacacagtggtcactgtttttctttgtttacgagaatgctttcttgccattcactcttggtattatggcaattgctgcatgtgctatgctgcttgttaagcataagcacgcattcttgtgcttgtttctgttaccttctcttgcaacagttgcttactttaatatggtctacatgcctgctagctgggtgatgcgtatcatgacatggcttgaattggctgacactagcttgtctggttataggcttaaggattgtgttatgtatgcttcagctttagttttgcttattctcatgacagctcgcactgtttatgatgatgctgctagacgtgtttggacactgatgaatgtcattacacttgtttacaaagtctactatggtaatgctttagatcaagctatttccatgtgggccttagttatttctgtaacctctaactattctggtgtcgttacgactaccatgtttttagctagagctatagtgtttgtgtgtgttgagtattacccattgttatttattactggcaacaccttacagtgtatcatgcttgtttattgtttcttaggctattgttgctgctgctactttggccttttctgtttactcaaccgttacttcaggcttactcttggtgtttatgactacttggtctctacacaagaatttaggtatatgaactcccaggggcttttgcctcctaagagtagtattgatgctttcaagcttaaccattaagttgttgggtattggaggtaaaccatgtatcaaggttgctactgtaccagtctaaaatgtctgacgtaaagtgcacatctgcggtactgctctcggttcttcaacaacttagagtagagtcatcttctaaattgtgggcacaatgtgtacaactccacaatgatattcttcttgcaaaagacacaactgaagctttcgagaagatggtttctcttttgtctgttttgctatccatgcagggtgctgtagacattaataggttgtgcgaggaaatgctcgataaccgtgctactcttcaggctattgcttcagaatttagttctttaccatcatatgccgcttatgccactgcccaggaggcctatgagcaggctgtagctaatggtgattctgaagtcgttctcaaaaagttaaagaaatctttgaatgtggctaaatctgagtttgaccgtgatgctgccatgcaacgcaagttggaaaagatggcagatcaggctatgacccaaatgtacaaacaggcaagatctgaggacaagagggcaaaagtaactagtgctatgcaaacaatgctcttcactatgcttaggaagcttgataatgatgcacttaacaacattatcaacaatgcgcgtgatggttgtgttccactcaacatcataccattgactacagcagccaaactcatggttgttgtccctgattatggtacctacaagaacacttgtgatggtaacacctttacatatgcatctgcactctgggaaatccagcaagttgttgatgcggatagcaagattgttcaacttagtgaaattaacatggacaattcaccaaatttggcttggcctcttattgttacagctctaagagccaactcagctgttaaactacagaatagtgaactgagtccagtagcactacgacagatgtcctgtgcggctggtaccacacaaacagcttgtactgatgacaatgcacttgcctactataacaatccgaagggagataggtttgtgctggcattactatcaggccaccaagatctcaaatgggctagattccctaagagtgatggtacaggtacaatttacacagaactggacccaccttgtaggtttgttacagacacaccaaaagggcctaaagtgaaatacttgtacttcatcaaaggcttaaacaacctaaatagaggtatggtgctgggcagtttagctgctacagtacgtcttcaggctggaaatgctacagaagtacctgccaattcagctgtgctttccttctgtgcttttgcagtagaccctgctaaagcatataaggattacctagcaagtggaggacaaccaatcaccaactgtgtgaagatgttgtgtacacacactggtacaggacaggcaattactgtaacaccagaagctaacatggaccaagagtcctttggtggtgcttcatgttgtctgtattgtagatgccacattgaccatccaaatcctaaaggattctgtgacttgaaaggtaagtacgtccaaatacctaccacttgtgctaatgacccagtgggttttacacttagaaacacagtctgtaccgtctgcggaatgtgaaaaggttatggctgtagttgtgaccaactccgcgaacccttgatgcagtctgcggacgcatcaacgtttttaaacgggtttgcggtgtaagtgcagcccgtcttacaccgtgcggcacaggcactagtactgatgtcgtctacagggcttttgatatttacaacgaaagagttgctggttttgcaaagttcctaaaaactaattgctgtcgcttccaggagaaggatgaggaaggcaatttattagactcttactttgtagttaagaggcatactatgtctaactaccaacatgaagagactatttataacttggttaaagattgtccagcggttgctgtccatgactttttcaagtttagagtagatggtgacatggtaccacatatatcacgtcagcgtctaactaaatacacaatggctgatttagtctatgctctacgtcattttgatgagggtaattgtgatacattaaaagaaatactcgtcacatacaattgctgtgatgatgattatttcaataagaaggattggtatgacttcgtagagaatcctgacatcttacgcgtatatgctaacttaggtgagcgtgtacgccaatcattattaaggactgtacaattctgcgatgctatgcgtgatgcaggcattgtaggcgtactgacattagataatcaggatcttaatgggaactggtacgatttcggagatttcgtacgagtagcacccaggctgcggagttcctattgtggattcatattactcattgctgatgccccatcctcactttgactagggccattggctgctgagtcccatatggatgctgatctcgcaaaacccacttattaagtgggatttgctgaaatatgattttacggaagagagactttgtctcttcgaccgttattttaaatattgggacccagacatacccatcccaattgtattaactgtttggatgataggtgtatccttcattgtgcaaactttaatgtgttattttctactgtgtttccacctacaagttttggaccactagtaagaaaaatatttgtagatggtgctccttttgttgtttcaactggataccattttcgtgagttaggagtcgtacataatcaggatgtaaacttacatagctcgcgtctcagtttcaaggaacttttagtgtatgctgctgatccagctatgcatgcagcttctggcaatttattgctagataaacgcactacatgcttttcagtagctgcactaacaaacaatgttgcttttcaaactgtcaaacccggtaattttaataaagacttttatgactttgctgtgtctaaaggtttctttaaggaaggaagttctgttgaactaaaacacttcttctttgctcaggatggcaacgctgctatcagtgattatgactattatcgttataatctgccaacaatgtgtgatatcagacaactcctattcgtagttgaagttgttgataaatactttgattgtcacgatggtggctgtattaatgccaaccaagtaatcgttaacaatctggataaatcagctggtttcccatttaataaatggggtaaggctagactttattatgactcaatgagttatgaggatcaagatgcacttgtcgcgtatactaagcgtaatgtcatccctactataactcaaatgaatcttaagtatgccattagtgcaaagaatagagctcgcaccgtagctggtgtctctatctgtagtactatgacaaatagacagtttcatcagaaattattgaagtcaatagccgccactagaggagctactgtggtaattggaacaagcaagttttacggtggctggcataatatgttaaaaactgtttacagtgatgtagaaactccacaccttatgggttgggattatccaaaatgtgacagagccatgcctaacatgcttaggataatggcctctcttgttcttgctcgcaaacataacacttgctgtaacttatcacaccgtttctacaggttagctaacgagtgtgcgcaagtattaagtgagatggtcatgtgtggcggctcactatatgttaaaccaggtggaacatcatccggtgatgctacaactgcttatgctaatagtgtctttaacatttgtcaagctgttacagccaatgtaaatgcacttctttcaactgatggtaataagatagctgacaagtatgtccgcaatctacaacacaggctctatgagtgtctctatagaaatagggatgttgatcatgaattcgtggatgagttttacgcttacctgcgtaaacatttctccatgatgattctttctgatgatgccgttgtgtgctataacagtaactatgcggctcaaggtttagtagctagcattaagaactttaaggcagttctttattatcaaaataatgtgttcatgtctgaggcaaaatgttggactgagactgactttactaaaggacctcacgaattttgctcacagcatacaatgctagttaaacaaggagatgattacgtgtacctgccttacccagatccatcaagaatattaggcgcaggctgttttgtcgatgatattgtcaaaacagatggtacacttatgattgaaaggttcgtgtcactggctattgatgcttacccacttacaaaacatcctaatcaggagtatgctgatgtctttcacttgtatttacaatacattagaaagttacatgatgagcttactggccacatgttggacatgtattccgtaatgctaactaatgataacacctcacggtactgggaacctgagttttatgaggctatgtacacaccacatacagtcttgcaggctgtaggtgcttgtgtattgtgcaattcacagacttcacttcgttgcggtgcctgtattaggagaccattcctatgttgcaagtgctgctatgaccatgtcatttcaacatcacacaaattagtgttgtctgttaatccctatgtttgcaatgccccgggttgtgatgtcactgatgtgacacaactgtatctaggaggtatgagctattattgcaagtcacataagcctcccattagttttccattatgtgctaatggtcaggtttttggtttatacaaaaacacatgtgtaggcagtgacaatgtcactgacttcaatgcgatagcaacatgtgattggactaatgctggcgattacatacttgccaacacttgtactgagagactcaagcttttcgcagcagaaacgctcaaagccactgaggaaacatttaagctgtcatatggtattgccactgtacgcgaagtactctctgacagagaattgcatctttcatgggaggttggaaaacctagaccaccattgaacagaaactatgtctttactggttaccgtgtaactaaaaataataaagtacagattggagagtacacctttgaaaaaggtgactatggtgatgctgttgtgtacagaggtactacgacatacaagttgaatgttggtgattactttgtgttgacatctcacactgtaatgccacttagtgcacctactctagtgccacaagagcactatgtgagaattactggcttgtacccaacactcaacatctcagatgagttttctagcaatgttgcaaattatcaaaaggtcggcatgcaaaagtactctacactccaaggaccacctggtactggtaagagtcattttgccatcggacttgctctctattacccatctgctcgcatagtgtatacggcatgctctcatgcagctgttgatgccctatgtgaaaaggcattaaaatatttgcccatagataaatgtagtagaatcatacctgcgcgtgcgcgcgtagagtgttttgataaattcaaagtgaattcaacactagaacagtatgttttctgcactgtaaatgcattgccagaaacaactgctgacattgtagtctttgatgaaatctctatggctactaattatgacttgagtgttgtcaatgctagacttcgtgcaaaacactacgtctatattggcgatcctgctcaattaccagccccccgcacattgctgactaaaggcacactagaaccagaatattttaattcagtgtgcagacttatgaaaacaataggtccagacatgttccttggaacttgtcgccgttgtcctgctgaaattgttgacactgtgagtgctttagtttatgacaataagctaaaagcacacaaggataagtcagctcaatgcttcaaaatgttctacaaaggtgttattacacatgatgtttcatctgcaatcaacagacctcaaataggcgttgtaagagaatttcttacacgcaatcctgcttggagaaaagctgtttttatctcaccttataattcacagaacgctgtagcttcaaaaatcttaggattgcctacgcagactgttgattcatcacagggttctgaatatgactatgtcatattcacacaaactactgaaacagcacactcttgtaatgtcaaccgcttcaatgtggctatcacaagggcaaaaattggcattttgtgcataatgtctgatagagatctttatgacaaactgcaatttacaagtctagaaataccacgtcgcaatgtggctacattacaagcagaaaatgtaactggactttttaaggactgtagtaagatcattactggtcttcatcctacacaggcacctacacacctcagcgttgatataaagttcaagactgaaggattatgtgttgacataccaggcataccaaaggacatgacctaccgtagactcatctctatgatgggtttcaaaatgaattaccaagtcaatggttaccctaatatgtttatcacccgcgaagaagctattcgtcacgttcgtgcgtggattggctttgatgtagagggctgtcatgcaactagagatgctgtgggcactgacctacctctccagctaggattttctacaggtgttaacttagtagctgtaccgactggttatgttgacactgaaaataacacagaattcaccagagttaatgcaaaacctccaccaggtgaccagtttaaacatcttataccactcatgtataaaggcttgccctggaatgtagtgcgtattaagatagtacaaatgctcagtgatacactgaaaggattgtcagacagagtcgtgttcgtcctttgggcgcatggctttgagcttacatcaatgaagtactttgtcaagattggacctgaaagaacgtgttgtctgtgtgacaaacgtgcaacttgcttttctacttcatcagatacttatgcctgctggaatcattctgtgggttttgactatgtctataacccatttatgattgatgttcagcagtggggctttacgggtaaccttcagagtaaccatgaccaacattgccaggtacatggaaatgcacatgtggctagttgtgatgctatcatgactagatgtttagcagtccatgagtgctttgttgagcgcgttgattggtctgttgaataccctattataggagatgaactgagggttaattctgcttgcagaaaagtacaacacatggttgtgaagtctgcattgcttgctgataagttcccagttcttcatgacattggaaatccaaaggctatcaagtgtgtgcctcaggctgaagtagaatggaagttctacgatgctcagccatgtagtgacaaagcttacaaaatagaggaactcttctattcttatgccacacatcacggtaaatttcactgatggtgtttgtttgttttggaattgtaacgttgatcgttacccagccaatgcaattgtgtgtaggtttgacacaagagtcttgtcaaacttgaacttaccaggctgtgatggtggtagtttgtatgtgaataagcatgcattccacactccagctttcgataaaagtgcatttactaatttaaagcaattgcctttcttttactattctgatagtccttgtgagtctcatggcaaacaagtagtgtcggatattgattatgttccactcaaatctgctacgtgtattacacgatgcaatttaggtggtgctgtttgcagacaccatgcaaatgagtaccgacagtacttggatgcatataatatgatgacttctgctggatttagcctatggatttacaaacaatttgatacttataacctgtggaatacatttaccaggttacagagtttagaaaatgtggcttataatgttgttaataaaggacactttgatggacacgccggcgaagcacctgtttccatcattaataatgctgtttacacaaaggtagatggtattgatgtggagatctttgaaaataagacaacacttcctattaatgttgcatttgagctttgggctaagcgtaacattaaaccagtgccagagattaagatactcaataatttgggtgttgatatcgctgctaatactgtaatctgggactacaaaagagaagccccagcacatgtatctacaataggtgtctgcacaatgactgacattgccaagaaacctactgagagtgcttgttcttcacttactgtcttgtttgatggtagagtggaaggacaggtagacctttttagaaacgcccgtaatggtgttttaataacagaaggtccagtcaaaggactaacaccttcaaaaggtccagcacaagctagcgtcaatggagtcacattaattggagaatcagtaaaaacacggtttaactactttaagaaagtagacggcattattcaacagttgcctgaaacctactttactcagagcagagacttagaggattttaagcccagatcacaaatggaaactgactttctcgagctcgctatggatgaattcatacagcgatataagctcgagggctatgccttcgaacacatcgtttatggagatttcagtcatggacaacttggcggtcttcatttaatgataggcttagccaagcgctcacaagattcaccacttaaattagaggattttatccctatggacagcacagtgaaaaattacttcataacagatgcgcaaacaggttcatcaaaatgtgtgtgttctgtgattgatcttttacttgatgactttgtcgagataataaagtcacaagatttgtcagtgatttcaaaagtggtcaaggttacaattgactatgctgaaatttcattcatgctttggtgtaaggatggacatgttgaaaccttctacccaaaactacaagcaagtcaagcgtggcaaccaggtgttgcgatgcctaacttgtacaagatgcaaagaatgcttcttgaaaagtgtgaccttcagcaattatggtgaaaatgctgttataccaaaaggaataatgatgaatgtcgcaaagtatactcaactgtgtcaatacttaaatacacttactttagccgtaccctacaacatgagagttattcactttggtgctggctctgataaaggagttgcaccaggtacagctgtgctcagacaatggttgccaactggcacactacttgtcgattcagatcttaatgacttcgtctccgacgcagattctactttaattggagactgtgcaacagtacatacggctaataaatgggaccttattattagcgatatgtatgaccctaggaccaaacatgtgacaaaagagaatgactctaaagaagggtttttcacttatctgtgtggatttataaagcaaaaactagccctgggtggttctatagctgtaaagataacagagcattcttggaatgctgacctttacaagcttatgggccatttctcatggtggacagcttttgttacaaatgtaaatgcatcatcatcggaagcatttttaattggggctaactatctcggcaagccgaaggaacaaattgatggctataccatgcatgctaactacattttctggaggaacacaaatcctatccagttgtcttcctattcactctttgacatgagcaaatttcctcttaaattaagaggaactgctgtaatgtctcttaaggagaatcaaatcaatgatatgatttattctcttctggaaaaaggtaggcttatcattagagaaaacaacagagttgtggtttcaagtgatattcttgttaacaactaaacgaacatgtttattttcttattatttcttactctcactagtggtagtgaccttgaccggtgcatcacttttgatgatgttcaagctcctaattacactcaacatacttcatctatgaggggggtttactatcctgatgaaatttttagatcagacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaagaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggggttattgctgattataattataaattgcccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaagcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgttagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctaagcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagccgaggcggaggtacaaattgacaggttaattacaggcagacttcaaagccttcaaacctatgtaacacaacaactaatcagggctgctgaaatcagggcttctgctaatcttgctactactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcactccttggtttattacacagaggaacttcttttctccacaaataattactacagacaatacatttgtctcaggaagttgtgatgtcgttattggcatcattaacaacacagtttatgatcctctacaacctgagcttgactcattcaaagaagagctggacaagtacttcaaaaatcatacatcaccggatgttgatcttggcgacatttcaggcattaacgcttctgtcgtcaacattcaaaaagaaattgaccgcctcaatgaggtcgctaaaaatttaaatgaatcactcattgaccttcaagaattgggaaaatatgagcaatatattaaatggccttggtatgtttggctcggcttcattgctggactaattgccatcgtcatggttacaatcttgctttgttgcatgactagttgttgcagttgcctcaagggtgcatgctcttgtggttcttgctgcaagtttgatgaggatgactctgagccagttctcaagggtgtcaaattacattacacataaacgaacttatggatttgtttgatgagattttttactcttagatcaattactgcacagccagtaaaaattgacaatgcttctcctgcaagtactgttcatgctacagcaacgataccgctacaagcctcactccctttcggatggcttgttattggcgttgcatttcttgctgtttttcagagcgctaccaaaataattgcgctcaataaaagatggcagctagccctttataagggcttccagttcatttgcaatttactgctgctatttgttaccatctattcacatcttttgcttgtcgctgcaggtatggaggcgcaatttttgtacctctatgccttgatatattttctacaatgcatcaacgcatgtagaattattatgagatgttggctttgttggaagtgcaaatccaagaacccattactttatgatgccaactactttgtttgctggcacacacataactatgactactgtataccatataacagtgtcacagatacaattgtcgttactgaaggtgacggcatttcaacaccaaaactcaaagaagactaccaaattggtggttattctgaggataggcactcaggtgttaaagactatgtcgttgtacatggctatttcaccgaagtttactaccagctggagtctacacaaattactacagacactggtattgaaaatgctacattcttcatctttaacaagcttgttaaggacccaccgaatgtgcaaatacacacaatcgacggctcttcaggagttgctaatccagcaatggatccaatttatgatgagccgacgacgactactagcgtgcctttgtaagcacaagaaagtgagtacgaacttatgtactcattcgtttcggaagaaacaggtacgttaatagttaatagcgtacttctttttcttgctttcgtggtattcttgctagtcacactagccatccttactgcgcttcgattgtgtgcgtactgctgcaatattgttaacgtgagtttagtaaaaccaacggtttacgtctactcgcgtgttaaaaatctgaactcttctgaaggagttcctgatcttctggtctaaacgaactaactattattattattctgtttggaactttaacattgcttatcatggcagacaacggtactattaccgttgaggagcttaaacaactcctggaacaatggaacctagtaataggtttcctattcctagcctggattatgttactacaatttgcctattctaatcggaacaggtttttgtacataataaagcttgttttcctctggctcttgtggccagtaacacttgcttgttttgtgcttgctgctgtctacagaattaattgggtgactggcgggattgcgattgcaatggcttgtattgtaggcttgatgtggcttagctacttcgttgcttccttcaggctgtttgctcgtacccgctcaatgtggtcattcaacccagaaacaaacattcttctcaatgtgcctctccgggggacaattgtgaccagaccgctcatggaaagtgaacttgtcattggtgctgtgatcattcgtggtcacttgcgaatggccggacactccctagggcgctgtgacattaaggacctgccaaaagagatcactgtggctacatcacgaacgctttcttattacaaattaggagcgtcgcagcgtgtaggcactgattcaggttttgctgcatacaaccgctaccgtattggaaactataaattaaatacagaccacgccggtagcaacgacaatattgctttgctagtacagtaagtgacaacagatgtttcatcttgttgacttccaggttacaatagcagagatattgattatcattatgaggactttcaggattgctatttggaatcttgacgttataataagttcaatagtgagacaattatttaagcctctaactaagaagaattattcggagttagatgatgaagaacctatggagttagattatccataaaacgaacatgaaaattattctcttcctgacattgattgtatttacatcttgcgagctatatcactatcaggagtgagttagaggtacgactgtactactaaaagaaccttgcccatcaggaacatacgagggcaattcaccatttcaccctcttgctgacaataaatttgcactaacttgcactagcacacactttgcttttgcttgtgctgacggtactcgacatacctatcagctgcgtgcaagatcagtttcaccaaaacttttcatcagacaagaggaggttcaacaagagctctactcgccactttttctcattgttgctgctctagtatttttaatactttgcttcaccattaagagaaagacagaatgaatgagctcactttaattgacttctatttgtgctttttagcctttctgctattccttgttttaataatgcttattatattttggttttcactcgaaatccaggatctagaagaaccttgtaccaaagtctaaacgaacatgaaacttctcattgttttgacttgtatttctctatgcagttgcatatgcactgtagtacagcgctgtgcatctaataaacctcatgtgcttgaagatccttgtaaggtacaacactaggggtaatacttatagcactgcttggctttgtgctctaggaaaggttttaccttttcatagatggcacactatggttcaaacatgcacacctaatgttactatcaactgtcaagatccagctggtggtgcgcttatagctaggtgttggtaccttcatgaaggtcaccaaactgctgcatttagagacgtacttgttgttttaaataaacgaacaaattaaaatgtctgataatggaccccaatcaaaccaacgtagtgccccccgcattacatttggtggacccacagattcaactgacaataaccagaatggaggacgcaatggggcaaggccaaaacagcgccgaccccaaggtttacccaataatactgcgtcttggttcacagctctcactcagcatggcaaggaggaacttagattccctcgaggccagggcgttccaatcaacaccaatagtggtccagatgaccaaattggctactaccgaagagctacccgacgagttcgtggtggtgacggcaaaatgaaagagctcagccccagatggtacttctattacctaggaactggcccagaagcttcacttccctacggcgctaacaaagaaggcatcgtatgggttgcaactgagggagccttgaatacacccaaagaccacattggcacccgcaatcctaataacaatgctgccaccgtgctacaacttcctcaaggaacaacattgccaaaaggcttctacgcagagggaagcagaggcggcagtcaagcctcttctcgctcctcatcacgtagtcgcggtaattcaagaattcactcctggcagcagtaggggaaattctcctgctcgaatggctagcggaggtggtgaaactgccctcgcgctattgctgctagacagattgaaccagcttgagagcaaagtttctggtaaaggccaacaacaacaaggccaaactgtcactaagaaatctgctgctgaggcatctaaaaagcctcgccaaaaacgtactgccacaaaacagtacaacgtcactcaagcatttgggagacgtggtccagaacaaacccaaggaaatttcggggaccaagacctaatcagacaaggaactgattacaaacattggccgcaaattgcacaatttgctccaagtgcctctgcattctttggaatgtcacgcattggcatggaagtcacaccttcgggaacatggctgacttatcatggagccattaaattggatgacaaagatccacaattcaaagacaacgtcatactgctgaacaagcacattgacgcatacaaaacattcccaccaacagagcctaaaaaggacaaaaagaaaaagactgatgaagctcagcctttgccgcagagacaaaagaagcagcccactgtgactcttcttcctgcggctgacatggatgatttctccagacaacttcaaaattccatgagtggagcttctgctgattcaactcaggcataaacactcatgatgaccacacaaggcagatgggctatgtaaacgttttcgcaattccgtttacgatacatagtctactcttgtgcagaatgaattctcgtaactaaacagcacaagtaggtttagttaactttaatctcacatagcaatctttaatcaatgtgtaacattagggaggacttgaaagagccaccacattttcatcgaggccacgcggagtacgatcgagggtacagtgaataatgctagggagagctgcctatatggaagagccctaatgtgtaaaattaattttagtagtgctatccccatgtgattttaatagcttcttaggagaatgacaa

SEQ ID NO: 89 - DNA, 28586 bp, Coronavirus
acttttaaagtaaagtgagtgtagcgtggctatatctcttcttttactttaactagccttgtgctagattttgtcttcggacaccaactcgaactaaacgaaatatttgtctttctatgaaatcatagaggacaagcgttgattatttccattcagtttggcaatcactccttggaacggggttgagcgaacggtgcagtagggttccgtccctatttcgtaagtcgcctagtagtagcgagtgcggttccgcccgtacaacgttgggtagaccgggttccgtcctgtgatctccctcgccggccgccaggagaatgagttccaaacaattcaagatccttgttaatgaggactatcaagtcaacgtgcctagtcttcctattcgtgacgtgttacaggaaattaagtactgctaccgtaatggatttgagggctatgttttcgtaccagaatactgtcgtgacctagttgattgcgatcgtaaggatcactacgtcattggtgttcttggtaacggagtaagtgatcttaaacctgttcttcttaccgaaccctccgtcatgttgcaaggctttattgttagagctaactgcaatggcgttcttgaggactttgaccttaaaattgctcgcactggcagaggtgccatatatgttgatcaatacatgtgtggtgctgatggaaaaccagtcattgaaggcgattttaaggactacttcggtgatgaagacatcattgaatttgaaggagaggagtaccattgcgcttggacaactgtgcgcgatgagaaaccgctgaatcagcaaactctctttaccattcaggaaatccaatacaatctggacattcctcataaattgccaaactgtgctactagacatgtagcaccaccagtcaaaaagaactctaaaatagttctgtctgaagattacaagaagctttatgatatcttcggatcaccctttatgggaaatggtgactgtcttagcaaatgctttgacactcttcattttatcgctgctactcttagatgcccgtgtggttctgaaagtagcggcgttggagattggactggttttaagactgcctgttgtggtctttctggcaaagttaagggtgtcactttgggtgatattaagcctggtgatgctgttgtcactagtatgagcgcaggtaagggagttaagttctttgccaattgtgttcttcaatatgctggtgatgttgaaggtgtctccatctggaaagttattaaaacttttacagttgatgagactgtatgcacccctggttttgaaggcgaattgaacgacttcatcaaacctgagagcaaatcactagttgcatgcagcgttaaaagagcattcattactggtgatattgatgatgctgtacatgattgtatcattacaggaaaattggatcttagtaccaacctttttggtaatgttggtctattattcaagaagactccatggtttgtacaaaagtgtggtgcactttttgtagacgcttggaaagtagtagaggagctttgtggttcactcacacttacatacaagcaaatttatgaagttgtagcatcactttgcacttctgcttttacgattgtaaactacaagccaacatttgtggttccagacaatcgtgttaaagatcttgtagacaagtgtgtgaaagttcttgtaaaagcatttgatgtttttacgcagattatcacaatagctggtattgaggccaaatgctttgtgcttggtgctaaatacctgttgttcaataatgcacttgtcaaacttgtcagtgttaaaatccttggcaagaagcaaaagggtcttgaatgtgcattctttgctactagcttggttggtgcaactgttaatgtgacacctaaaagaacagagactgccactatcagcttgaacaaggttgatgatgttgtagcaccaggagagggttatatcgtcattgttggtgatatggctttctacaagagtggtgaatattatttcatgatgtctagtcctaattttgttcttactaacaatgtttttaaagcagttaaagttccatcttatgacatcgtttatgatgttgataatgataccaaaagcaaaatgattgcaaaacttggttcatcatttgaatatgatggtgatattgatgctgctattgtaaaagtcaatgaactactcattgaatttaggcagcaaagcttgtgcttcagagcttttaaggacgacaaaagcatttttgttgaagcctattttaaaaagtataaaatgccagcatgccttgcaaaacatattggtttgtggaacatcataaagaaagattcatgtaagaggggttttcttaatctcttcaatcacttgaatgaattggaagatatcaaagaaactaatattcaggctattaaaaacattctttgccctgatcctcttcttgatctggattatggtgccatttggtacaattgcatgccaggttgctctgatccttcagttttggggagtgttcaacttttgatcggtaatggtgtgaaagtagtttgtgatggctgcaaaggttttgctaaccaactttcaaaaggttacaacaagctctgtaatgcggctcgcaatgatattgagatcggtggtataccattttccacttttaaaacacctacaaatacttttattgaaatgacagatgctatctattcagttattgaacaaggtaaggcattatcctttagagatgctgatgtgccagttgtagacaatggtaccatttctactgctgattggtctgaacccattctgcttgaacctgctgaatatgtaaaaccaaagaacaatggtaatgtcattgttattgcaggttatacattttataaagatgaggatgaacatttttatccttatggttttggtaaaattgtgcagagaatgtataataaaatgggtggtggtgacaaaactgtctcattttcagaagaagtagatgttcaagaaattgcacctgttacacgtgttaaacttgaattcgaatttgacaatgaaattgtaactggtgttcttgaacgggctattggtactagatacaaatttactggtacaacttgggaagaatttgaagagtctatttctgaagaactcgatgcaatctttgatactctagcaaaccaaggtgtcgaacttgaaggttacttcatttatgacacttgtggtggctttgatataaaaaatccagatggtattatgatctctcagtatgatatcaatattactgctgatgaaaaatcagaagttagtgcatcaagtgaagaagaagaagttgaatctgttgaagaagatcctgagaatgaaattgtagaagcatctgaaggtgctgaagggacttcttctcaagaagaggttgaaacagtagaagttgcagatattacttctacagaagaagatgttgacattgttgaagtatctgctaaagatgacccttgggctgcagctgttgatgtacaagaagctgaacaatttaatccttctctaccacctttcaagacaacgaatctcaacggaaaaattatccttaagcaaggggataataattgttggataaatgcttgttgctatcagcttcaggcctttgattttttcaacaatgaagcttgggagaaatttaagaaaggtgatgtcatggactttgtaaacctttgttatgcagcaacaacactagcaagaggtcattctggtgatgcagagtatcttcttgaacttatgctcaatgattatagcacagccaagatagtacttgcagctaagtgtggttgtggtgaaaaagaaattgttttggaaagagctgtttttaaactcaccccacttaaggagagttttaattatggtgtttgtggtgactgcatgcaagttaacacctgtagatttttaagtgttgaaggctctggtgtttttgttcatgacatattaagcaagcaaacgccagaagctatgtttgttgtcaaacctgttatgcatgcagtttacactggcacaactcaaaatggccattacatggttgatgatattgaacacggttattgtgtagatggtatgggtattaaaccacttaagaaacggtgttatacatccacattgttcattaatgccaatgtaatgactagagctgaaaaaccaaaacaagagtttaaagttgaaaaagtagaacagcaaccgatagtggaggaaaacaaatcctctattgaaaaagaggaaattcaaagtcctaaaaacgatgaccttatacttccattttacaaagctggtaaactttccttttatcagggtgctttggatgttttgatcaatttcttggaacctgatgttattgttaatgctgctaatggtgatcttaaacacatgggtggtgtcgcaagagccatcgatgttttcactggtggcaaattaacagaacgttctaaggattatcttaaaaagaacaaatctattgctcctggtaatgctgttttctttgaaaatgtcattgagcatcttagtgttttgaatgcagttggaccacgtaatggtgacagccgagttgaagccaaactttgtaatgtttacaaagcaattgcaaagtgtgaaggaaaaatattaacaccacttattagtgttggtatctttaatgttagacttgaaacatcattgcagtgcttacttaagactgtgaatgacaggggattgaatgtcttcgtatacactgaccaggagaggcaaactattgagaatttcttctcttgttctatccctgtcaatgttactgaggataatgttaaccatgaacgtgtgtctgtttcttttgacaaaacatacggtgaacagcttaagggcaccgttgtcatcaaagacaaagatgttacaaaccagttgcctagcgcttttgatgttggtcaaaaagttattaaggctattgatatagattggcaagctcattatggtttccgtgatgctgctgcttttagcgctagtagtcatgatgcttataaatttgaagttgttacacatagcaatttcattgtgcataagcagactgacaacaactgttggattaatgcaatttgtcttgcattacagagactcaagccacagtggaaatttcctggtgttagaggtctctggaatgaatttcttgagcgtaaaacacaaggttttgtacatatgttgtatcacatttctggagtaaagaaaggtgagccaggtgatgctgaattaatgctgcataaacttggtgacttgatggacaatgattgtgaaatcattgtcacacacactacagcatgtgacaagtgcgcaaaagtagaaaagtttgttggaccagtggtagcagcacctcttgcaattcatggcactgacgaaacatgtgtgcatggcgttagtgtcaatgtcaaagtcacccaaattaagggcactgttgctattacttctttgattggtcctattattggagaagtactagaagcaactggttatatttgttatagcggttctaacaggaatggtcattacacctattacgataaccgtaatggattagtggttgatgcagaaaaggcttaccattttaatagagacttattacaggtcacaacagctattgcaagtaatttcgttgtcaagaaaccacaagcagaggaaagacctaagaattgtgcttttaacaaagttgcagcatctcctaagattgtacaagaacaaaaattgttggctattgaaagtggtgctaactatgctcttactgaatttggaagatatgctgacatgttctttatggctggagataaaattcttaggttgctgcttgaagtctttaaatatttgctggttttatttatgtgtcttagaagtactaagatgcctaaagttaaagtcaaaccacctcttgcatttaaagattttggtgctaaggtcagaacgctcaattacatgagacaattgaacaaaccctctgtctggcgttacgcaaaactagttttattgttgatagcaatatataatttcttttatttgtttgtcagtataccagtagtgcataaattaacatgtaacggtgctgtacaggcatataaaaattctagttttataaagtctgcagtctgtggcaactctattttatgcaaagcctgtttggcttcttatgatgagttggctgattttcaacatctccaagttacttgggatttcaaatctgacccactatggaacagactggtacaattgtcttactttgcattcttggctgtttttggtaataactatgttaggtgttttcttatgtattttgtatctcagtacctcaacctttggctttcttattttggttatgtagagtacagttggtttttgcatgttgtcaactttgaatccatctcagctgagtttgtgatcgtagttatagtggttaaggcagttctcgcccttaaacatattgttttcgcatgctcaaacccgtcttgcaaaacgtgctctaggactgcaaggcagacacgtattcctattcaagttgttgttaatggttcaatgaagactgtttatgttcatgctaatggtactggtaaattctgcaagaaacacaatttttattgtaagaactgtgattcttatggctttgaaaacacattcatctgtgacgaaattgtacgtgatctcagtaatagtgttaaacaaactgtttacgccactgatagatctcatcaagaagtcacaaaagttgaatgttcagatggcttttacagattttatgttggtgatgaattcacttcatatgactatgatgtaaaacacaagaaatacagtagtcaagaggttctcaagagcatgctcttgcttgatgacttcattgtgtacagtccatctggttctgctcttgcaaatgttagaaatgcctgtgtttacttttcacaacttattggtaagcctattaagattgttaacagtgatttgcttgaagacctctctgtagattttaaaggggcactttttaatgctaaaaagaatgtaattaagaattctttcaatgttgatgtctcagaatgcaaaaatcttgacgaatgttacagggcttgcaatcttaatgtttcattttctacatttgaaatggctgtcaacaatgctcataggtttggtattctgattactgatcgttcttttaacaatttctggccatcaaaagttaagcctggttcatctggtgtgtcggccatggacattggtaagtgtatgacttctgatgctaagattgttaatgctaaagttttaactcaacgtggtaaaagtgttgtttggcttagccaggattttgctgcacttagctcaactgctcagaaagttttggttaaaacttttgtagaagaaggtgtcaacttttcactcacatttaatgctgtaggttcagatgatgatcttccttatgaaagattcactgaatctgtgtctccaaaaagtggttcaggctttttcgatgtaattacacagcttaaacaaattgtgattttggtttttgtttttatctttatttgtggtttgtgctctgtttacagtgttgctacacagtcctacattgaatctgctgaaggctatgactacatggttattaagaatggaattgttcaaccttttgacgataccatttcatgtgttcataacacttataaaggattcggtgactggtttaaagctaagtatggttttatccctacttttggtaaatcatgtccaattgttgtaggaactgtttttgatcttgaaaatatgagaccaattcctgacgtgcctgcatatgtttctattgtgggtagatctcttgttttcgctattaatgctgcttttggtgttactaatatgtgctatgatcatactggcaatgcagttagtaaggactcttactttgatacttgtgtgtttaatactgcgtgcaccactcttacaggtcttggtggtacaattgtatattgtgcaaagcaaggtttagttgaaggtgctaagctctatagtgatcttatgccagactattattatgagcatgctagtggtaacatggttaaattgccagcaattattagaggacttggtctacgttttgtgaaaacacaggctacaacttattgtagagtgggagagtgcattgatagtaaagctggtttttgctttggtggcgataactggtttgtctacgacaatgagtttggcaatggatacatctgtggtaattctgtgctaggattctttaagaatgtcttcaaactctttaactctaacatgtctgtggtagctacatctggtgcgatgcttgttaacattattattgcatgcttagctattgcaatgtgttatggtgttcttaagtttaagaagatttttggtgattgtactttcctcattgttatgatcattgtcacccttgttgtgaacaatgtgtcttattttgtcactcaaaacacgttctttatgatcatctacgccattgtttactattttataacaagaaaacttgcatacccaggcattcttgatgctgggtttattattgcttatattaatatggctccatggtacgtgattaccgcatatatcctagttttcctctatgactcactcccttcactgtttaaacttaaagtttcaacaaatctttttgaaggtgataaatttgtgggtaactttgaatctgctgctatgggtacttttgttattgacatgcgttcatatgaaactattgttaattctacttctattgctagaattaaatcatatgctaacagcttcaataaatataagtactacacaggttcaatgggagaagctgactacagaatggcttgctatgctcatcttggtaaagctcttatggactattctgttaatagaacagacatgctttacacacctcctactgttagtgttaattctacacttcagtcaggtttgcggaaaatggcacagcctagtggtcttgtagagccttgcattgtaagagtttcctatggtaacaatgtgcttaatggtttatggttaggagatgaagtcatttgccctagacatgttattgctagtgataccacacgtgttatcaactatgaaaatgaaatgtctagtgtgagacttcacaacttttcagtttctaagaataatgtgtttttgggtgttgtgtctgccagatataagggtgtgaatcttgtacttaaagtcaaccaggttaatcctaacacaccagaacataaatttaagtctattaaagctggtgaaagttttaacattcttgcttgttatgaaggatgtcctggcagtgtttatggtgtcaacatgagaagtcaaggtaccattaaaggatcttttatagctggtacttgtggatcagtaggttatgtgttagaaaatggaattctctattttgtatacatgcatcacttagaacttggaaatggctcgcatgttggttccaattttgaaggagaaatgtacggtggttatgaagatcaacctagcatgcaattggaaggtactaatgtcatgtcatcagataatgtggttgcattcctatatgctgcacttatcaatggtgaaaggtggtttgttacaaacacatcgatgtcattagaatcatacaatacatgggccaaaactaacagtttcacagaactttcttcaactgatgcttttagcatgttggctgcaaaaactggtcaaagtgttgagaaattactagatagcatcgtaagactcaacaagggttttggaggtcgtactatactttcttatggctcattgtgtgacgagttcactccaactgaagtcataaggcaaatgtatggtgtaaatcttcaggctggtaaagtaaaatctttcttctaccctattatgactgcaatgacaattctctttgccttttggcttgaattctttatgtacacacccttcacttggattaatccaacttttgttagcattgtattggctgttacaactttgatctcgacggtttttgtctctggcatcaaacataagatgttgttctttatgtcttttgtccttcctagtgttatccttgtgacagcacacaatttgttctgggacttttcttactatgaaagtcttcagtcaattgttgagaatactaacactatgtttttgcctgttgacatgcaaggtgtcatgctcacagtgttttgctttattgtctttgttacatatagtgttagattcttcacttgcaaacaatcatggttctcacttgctgtgacaactattcttgtgatctttaacatggttaaaatctttggaacatctgatgaaccatggactgaaaaccaaattgctttctgctttgtgaacatgcttactatgattgtcagtcttactacaaaggattggatggttgtcattgcatcatacagaattgcatattatattgttgtatgtgtaatgccatctgcttttgtatctgactttgggtttatgaagtgtattagcattgtttacatggcgtgcggttatttgttttgttgctattatggcattctttattgggttaacagatttacatgcatgacttgtggtgtttatcaattcactgtgtctgcagctgaacttaaatacatgaccgctaacaacctttctgcacctaagaacgcatatgacgctatgattcttagtgctaaattgattggtgttggaggtaagagaaacatcaaaatttcaactgtacagtcaaaacttacagagatgaaatgtaccaatgttgtcttgcttggtcttttatctaaaatgcatgtcgagtctaactcaaaagagtggaactattgtgttggactacacaatgagataaacctttgtgacgatcctgaaatcgttcttgagaaactgttagctcttattgcattcttcttgtccaaacataacacttgtgaccttagcgaacttattgaatcatactttgagaacaccaccatactccagagtgtggcttcagcttatgctgcattgcctagctggattgcacttgaaaaagctcgcgctgatcttgaagaggctaagaaaaatgatgttagccctcaaattttgaagcagcttactaaagcatttaacattgccaagagtgattttgagcgcgaagcatcagtgcaaaagaaactcgacaaaatggctgagcaggctgcagctagtatgtataaagaagcacgagctgtggacagaaagtcaaagattgtttctgctatgcatagcctactttttggtatgcttaagaaacttgatatgtccagtgtcaacactattattgaccaggctcgtaatggtgttctacctttaagtatcattccagctgcatcagctacaagacttgttgttattacacctagccttgaagtgttttccaagattaggcaagaaaacaatgttcattatgctggtgctatttggactattgttgaagttaaagatgctaatggttcacatgtacatcttaaggaagtcaccgctgctaatgaattaaaccttacttggccattgagcattacttgtgagagaaccacaaagcttcagaacaatgaaattatgccaggtaaacttaaagaaagagctgtcagagcgtcagcaactcttgatggtgaagctttcggcagtggaaaggctcttatggcatctgaaagtggaaaaagctttatgtatgcatttatagcctcagacaacaatcttaagtatgttaagtgggagagcaataatgatattatacctattgaacttgaagctccattgcgtttctatgttgacggcgctaatggtcctgaagtcaagtatttgtattttgtcaagaatttaaacactcttagacgtggtgccgttcttggttatatcggtgcaacagttcgtctgcaagctggtaaacccactgaacatccatctaacagtagtttattgacattgtgtgctttttcacctgatcctgctaaagcatatgttgatgctgttaagagaggcatgcaaccagttaataactgtgtaaaaatgctctcaaatggtgctggtaatggtatggctgttacaaacggtgtcgaagctaacacacaacaggactcttatggtggtgcttcagtttgtatttattgcagatgccatgttgaacatcctgctattgatggattatgccgctacaaaggtaagttcgtgcaaataccaactggcacacaagatccaattcggttctgtattgaaaatgaagtttgtgttgtctgtggttgttggcttaacaatggttgcatgtgcgatcgtacttctatgcagagttttactgttgatcaaagttatttaaacgagtgcggggttctagtgcagctcgactagaaccctgcaatggtactgatccagaccatgttagtagagcttttgacatctacaacaaagatgttgcgtgtattggtaaattccttaagacgaattgttcaagatttaggaatttggacaaacatgatgcctactacattgtcaaacgttgtacaaagaccgttatggaccatgagcaagtctgttataacgatcttaaagattctggtgctgttgctgagcatgacttcttcacatataaagagggtagatgtgagttcggtaatgttgcacgtaggaatcttacaaagtacacaatgatggatctttgttacgctatcagaaattttgatgaaaagaactgtgaagttctcaaagaaatactcgtgacagtaggtgcttgcactgaagaattctttgaaaataaagattggtttgatccagttgaaaatgaagccatacatgaagtttatgcaaaacttggacccattgtagccaatgctatgcttaaatgtgttgctttttgcgatgcgatagtggaaaaaggctatataggtgttataacacttgacaaccaagatcttaatggcaatttctacgatttcggcgatttcgtgaagactgctccgggttttggttgcgcttgtgttacatcatattattcttatatgatgcctttaatggggatgacttcatgcttagagtctgaaaactttgtgaaaagtgacatctatggttctgattataagcagtatgatttactagcttatgattttaccgaacataaggagtaccttttccaaaaatactttaagtactgggatcgcacatatcacccaaattgttctgattgtactagtgacgagtgtattattcattgtgctaattttaacacattgttttctatgacaataccaatgacagcttttggaccacttgtccgtaaagttcatattgatggtgtaccagtagttgttactgcaggttaccatttcaaacaacttggtatagtatggaatcttgatgtaaaattagacacaatgaagttgagcatgactgatcttcttagatttgtcacagatccaacacttcttgtagcatcaagccctgcacttttagaccagcgtactgtctgtttctccattgcagctttgagtactggtattacatatcagacagtaaaaccaggtcactttaacaaggatttctacgatttcataacagagcgtggattctttgaagagggatctgagttaacattaaaacattttttctttgcacagggtggtgaagctgctatgacagacttcaattattatcgctacaatagagtcacagtacttgatatttgccaagctcaatttgtttacaaaatagttggcaagtattttgaatgttatgacggtgggtgcattaatgctcgtgaagttgttgttacaaactatgacaagagtgctggctatcctttgaacaaatttggtaaagctagactttactacgaaactctttcatatgaagagcaggatgcactttttgctttaacaaagagaaatgttttacccacaatgactcaaatgaatttgaaatacgctatttctggtaaggcaagagctcgtacagtaggaggagtttcacttctttctaccatgactacgagacaatatcatcagaagcatttgaagtcaattgctgcaacacgcaatgctactgtggtcattggttcaaccaagttttatggtggttgggacaatatgcttaaaaatttaatgcgtgatgttgataatggttgtttgatgggatgggactatcctaagtgtgaccgtgctttacctaatatgattagaatggcttctgccatgatattaggttctaagcatgttggttgttgtacacataatgataggttctaccgcctctccaatgagttagctcaagtactcacagaagttgtgcattgcacaggtggtttttattttaaacctggtggtacaactagcggtgatggtactacagcatatgctaactctgcttttaacatctttcaagctgtttctgctaatgttaataagcttttgggggttgattcaaacgcttgtaacaacgttacagtaaaatccatacaacgtaaaatttacgataattgttatcgtagtagcagcattgatgaagaatttgttgttgagtactttagttatttgagaaaacacttttctatgatgattttatctgatgatggagttgtgtgctacaacaaagattatgcggatttaggttatgtagctgacattaatgcttttaaagcaacactttattaccagaataacgtctttatgtccacttctaagtgttgggtagaaccagatcttagtgttggaccacatgaattttgttcacagcatacattgcagattgttgggcctgatggagactactatcttccctatccagacccgtccagaattttgtcagctggtgtgtttgttgatgacatagttaaaacagacaatgttattatgttagaacgttacgtgtcattggctattgacgcatacccgctcacaaaacaccctaagcctgcttatcaaaaagtgttttacactctactagattgggttaaacatctacagaaaaatttgaatgcaggtgttcttgattcgttttcagtgacaatgttagaggaaggtcaagataagttctggagtgaagagttttacgctagcctctatgaaaagtccactgtcttgcaagctgcaggcatgtgtgtagtatgtggttcgcaaactgtacttcgttgtggagactgtcttaggagaccacttttatgcacgaaatgtgcttacgaccatgttatgggaacaaagcataaattcattatgtctatcacaccatatgtgtgtagttttaatggttgtaatgtcaatgatgttacaaagttgtttttaggtggtcttagttattattgtatgaaccacaaaccacagttgtcattcccactctgtgctaatggcaacgtttttggtctatataaaagtagtgcagtcggctcagaggctgttgaagatttcaacaaacttgcagtttctgactggactaatgtagaagactacaaacttgctaacaatgtcaaggaatctctgaaaattttcgctgctgaaactgtgaaagctaaggaggagtctgttaaatctgaatatgcttatgctgtattaaaggaggttatcggccctaaggaaattgtactccaatgggaagcttctaagactaagcctccacttaacagaaattcagttttcacgtgttttcagataagtaaggatactaaaattcaattaggtgaatttgtgtttgagcaatctgagtacggtagtgattctgtttattacaagagcacgagtacttacaaattgacaccaggtatgatttttgtgttgacttctcataatgtgagtcctcttaaagctccaattttagtcaaccaagaaaagtacaataccatatctaagctctatcctgtctttaatatagcggaggcctataatacactggttccttactaccaaatgataggtaagcaaaaatttacaactatccaaggtcctcctggtagcggtaaatctcattgtgttataggtttgggtttgtattaccctcaggcgagaatagtctacactgcatgttctcatgcggctgtagacgctttatgtgaaaaagcagccaaaaacttcaatgttgatagatgttcaaggataatacctcaaagaatcagagttgattgttacacaggctttaagcctaataacaccaatgcgcagtacttgttttgtactgttaatgctctaccagaagcaagttgtgacattgttgtagttgatgaggtctctatgtgtactaattatgatcttagtgtcataaatagccgactgagttacaaacatattgtttatgttggagacccacagcagctaccagctcctagaactttgattaataagggtgtacttcaaccgcaggattacaatgttgtaaccaaaagaatgtgcacactaggacctgatgtctttttgcataaatgttacaggtgcccagctgaaattgttaagacagtctctgcacttgtttatgaaaataaatttgtacctgtcaacccagaatcaaagcagtgcttcaaaatgtttgtaaaaggtcaggttcagattgagtctaactcttctataaacaacaagcaactagaggttgtcaaggcctttttagcacataatccaaaatggcgtaaagctgttttcatctcaccctataatagtcaaaattatgttgctcggcgtcttcttggtttgcaaacgcaaactgtggattccgctcagggtagtgagtatgattacgtcatctacacacagacctccgatacacagcatgctactaatgttaacagatttaatgttgccattacgagagcaaaggttggtatactttgtatcatgtgtgatagaactatgtatgagaatcttgatttctatgaactcaaagattcaaagattggtttacaagcaaaacctgaaacttgtggtttatttaaagattgttcgaagagcgaacaatacataccacctgcttatgcaacgacatatatgagcttatctgataattttaagacaagtgatggtttagctgttaacatcggtacaaaagatgttaaatatgctaatgtcatctcatatatgggattcaggtttgaagccaacataccaggctatcacacactattctgcacgcgagattttgctatgcgtaatgttagagcatggcttgggtttgacgttgaaggtgcacatgtctgtggtgataatgttggaactaatgtaccattacagctgggtttctcaaacggtgtggattttgtagtgcaaactgaaggatgtgttattactgaaaaaggtaatagcattgaggttgtaaaagcacgagcaccaccaggtgagcaatttgcacacttgattccgcttatgagaaagggtcaaccttggcacattgttagacgccgtatagtgcagatggtctgtgactattttgatggcttatcagacattctgatctttgtgctttgggctggtggtcttgaacttacaactatgagatactttgttaaaattggaagaccacaaaaatgtgaatgcggcaaaagtgcaacttgttatagtagctctcaatctgtttatgcttgcttcaagcatgcattaggatgtgattatttatataacccttactgcattgacatacagcaatggggttacacaggatctttgagcatgaatcatcatgaagtttgcaacattcatagaaatgagcatgtagctagtggtgatgctatcatgactagatgtctcgctatacatgactgttttgtcaaacgtgttgattggtcaattgtgtacccttttattgacaatgaagaaaagatcaataaagctggtcgcatagtgcagtcacatgtcatgaaagctgctctgaagatttttaatcctgctgcaattcacgatgtgggtaatccaaaaggcatccgttgtgctacaacaccaataccatggttttgttatgatcgtgatcctattaataacaatgttagatgtctggattatgactatatggtacatggtcaaatgaatggtcttatgttattttggaactgtaatgtagacatgtacccagagttttcaattgtttgtagatttgatactcgcactcgctctaaattgtctttagaaggttgtaatggtggtgcattgtatgttaataaccatgctttccacacaccagcttatgatagaagagcttttgctaagcttaaacctatgccattcttttactatgatgatagtaattgtgaacttgttgatgggcaacctaattatgtaccacttaagtcaaatgtttgcataacaaaatgcaacattggtggtgctgtctgcaagaagcatgctgctctttacagagcgtatgttgaggattacaacatttttatgcaggctggttttacaatatggtgtcctcaaaactttgacacctatatgctttggcatggttttgttaatagcaaagcacttcagagtctagaaaatgtggcttttaatgtcgttaagaaaggtgccttcaccggtttaaaaggtgacttaccaactgctgttattgctgacaaaataatggtaagagatggacctactgacaaatgtatttttacaaataagactagtttacctacaaatgtagcttttgagttatatgcaaaacgcaaacttggactcacacctccattaacaatacttaggaatttaggtgttgtcgcaacatataagtttgtgttgtgggattatgaagctgaacgtcctttctcaaatttcactaagcaagtgtgttcctacactgatcttgatagtgaagttgtaacatgttttgataatagtattgctggttcttttgagcgttttactactacaagagatgcagtgcttatttctaataacgctgtgaaagggcttagtgccattaaattacaatatggccttttgaatgatctacctgtaagtactgttggaaataaacctgtcacatggtatatctatgtgcgcaagaatggtgagtacgtcgaacaaatcgatagttactatacacagggacgtacttttgaaaccttcaaacctcgtagtacaatggaagaagattttcttagtatggatactacactcttcatccaaaagtatggtcttgaggattatggttttgaacacgttgtatttggagatgtctctaaaactaccattggtggtatgcatcttcttatatcgcaagtgcgccttgcaaaaatgggtttgttttccgttcaagaatttatgaataattctgacagtacactgaaaagttgttgtattacatatgctgatgatccatcttctaagaatgtgtgcacttatatggacatactcttggacgattttgtgactatcattaagagcttagatcttaatgttgtgtccaaagttgtggatgtcattgtagattgtaaggcatggagatggatgttgtggtgtgagaattcacatattaaaaccttctatccacaactccaatctgctgaatggaatcccggctatagcatgcctacactgtacaaaatccagcgtatgtgtctcgaacggtgtaatctctacaattatggtgcacaagtgaaattacctgatggcattactactaatgtcgttaagtatactcagttgtgtcaataccttaacactactacattgtgtgtaccacacaaaatgcgtgtattgcatttaggagctgctggtgcatctggtgttgctcctggtagtactgtattaagaagatggttaccagatgatgccatattggttgataatgatttgagagattacgtttccgacgcagacttcagtgttacaggtgattgtactagtctttacatcgaagacaagtttgatttgctcgtctctgatttatatgatggctccacaaaatcaattgacggtgaaaacacgtcgaaagatggtttctttacttatattaatggtttcattaaagagaaactgtcacttggtggatctgttgccattaaaatcacggaatttagttggaataaagatttatatgaattgattcaaagatttgagtattggactgtgttttgtacaagtgttaacacgtcatcatcagaaggctttctgattggtattaactacttaggaccatactgtgacaaagcaatagtagatggaaatataatgcatgccaattatatattttggagaaactctacaattatggctctatcacataactcagtcctagacactcctaaattcaagtgtcgttgtaacaacgcacttattgttaatttaaaagaaaaagaattgaatgaaatggtcattggattactaaggaagggtaagttgctcattagaaataatggtaagttactaaactttggtaaccacttcgttaacacaccatgaaaaaactatttgtggttttggtcgtaatgccattgatttatggagacaattttccttgttctaaattgactaatagaactataggcaaccagtggaatctcattgaaaccttccttctaaactatagtagtaggttaccacctaattcagatgtggtgttaggtgattattttcctactgtacaaccttggtttaattgcattcgcaatgatagtaatgacctttatgttacactggaaaatcttaaagcattgtattgggattatgctacagaaaatatcacttggaatcacagacaacggttaaacgtagtcgttaatggatacccatactccatcacagttacaacaacccgcaattttaattctgctgaaggtgctattatatgcatttgtaagggctcaccacctactaccaccacagaatctagtttgacttgcaattggggtagtgagtgcaggttaaaccataagttccctatatgtccttctaattcagaggcaaattgtggtaatatgctgtatggcctacaatggtttgcagatgaggttgttgcttatttacatggtgctagttaccgtattagttttgaaaatcaatggtctggcactgtcacatttggtgatatgcgtgcgacaacattagaagtcgctggcacgcttgtagacctttggtggtttaatcctgtttatgatgtcagttattatagggttaataataaaaatggtactaccgtagtttccaattgcactgatcaatgtgctagttatgtggctaatgtttttactacacagccaggaggttttataccatcagattttagttttaataattggttccttctaactaatagctccacgttggttagtggtaaattagttaccaaacagccgttattagttaattgcttatggccagtccctagctttgaagaagcagcttctacattttgttttgagggtgctggctttgatcaatgtaatggtgctgttttaaataatactgtagacgtcattaggttcaaccttaattttactacaaatgtacaatcaggtaagggtgccacagtgttttcattgaacacaacgggtggtgtcactcttgaaatttcatgttatacagtgagtgactcgagctttttcagttacggtgaaattccgttcggcgtaactgatggaccacggtactgttacgtacactataatggcacagctcttaagtatttaggaacattaccacctagtgtcaaggagattgctattagtaagtggggccatttttatattaatggttacaatttctttagcacatttcctattgattgtatatcttttaatttgaccactggtgatagtgacgttttctggacaatagcttacacatcgtacactgaagcattagtacaagttgaaaacacagctattacaaaggtgacgtattgtaatagtcacgttaataacattaaatgctctcaaattactgctaatttgaataatggattttatcctgtttcttcaagtgaagttggtcttgtcaataagagtgttgtgttactacctagcttttacacacataccattgttaacataactattggtcttggtatgaagcgtagtggttatggtcaacccatagcctcaacattaagtaacatcacactaccaatgcaggatcacaacaccgatgtgtactgtattcgttctgaccaattttcagtttatgttcattctacttgcaaaagtgctttatgggacaatatttttaagcgaaactgcacggacgttttagatgccacagctgttataaaaactggtacttgtcctttctcatttgataaattgaacaattacttaacttttaacaagttctgtttgtcgttgagtcctgttggtgctaattgtaagtttgatgtagctgcccgtacaagaaccaatgagcaggttgttagaagtttgtatgtaatatatgaagaaggagacaacatagtgggtgtaccgtctgataatagtggtgtgcacgatttgtcagtgctacacctagattcctgcacagattacaatatatatggtagaactggtgttggtattattagacaaactaacaggacgctacttagtggcttatattacacatcactatcaggtgatttgttaggttttaaaaatgttagtgatggtgtcatctactctgtaacgccatgtgatgtaagcgcacaagcagctgttattgatggtaccatagttggggctatcacttccattaacagtgaactgttaggtctaacacattggacaacaacacctaatttttattactactctatatataattacacaaatgataggactcgtggcactgcaattgacagtaatgatgttgattgtgaacctgtcataacctattctaacataggtgtttgtaaaaatggtgcttttgtttttattaacgtcacacattctgatggagacgtgcaaccaattagcactggtaatgtcacgatacctacaaactttaccatatccgtgcaagtcgaatatattcaggtttacactacaccagtgtcaatagactgttcaagatatgtttgtaatggtaaccctaggtgtaacaaattgttaacacaatacgtttctgcatgtcaaactattgagcaagcacttgcaatgggtgccagacttgaaaacatggaggttgattccatgttgtttgtttctgaaaatgcccttaaattggcatctgttgaagcattcaatagttcagaaactttagaccctatttacaaagaatggcctaatataggtggttcttggctagaaggtctaaaatacatacttccgtcccataatagcaaacgtaagtatcgttcagctatagaggacttgctttttgataaggttgtaacatctggtttaggtacagttgatgaagattataaacgttgtacaggtggttatgacatagctgacttagtatgtgctcaatactataatggcatcatggtgctacctggtgtggctaatgctgacaaaatgactatgtacacagcatcccttgcaggtggtataacattaggtgcacttggtggaggcgccgtggctataccttttgcagtagcagttcaggctagacttaattatgttgctctacaaactgatgtattgaacaaaaaccagcagattctggctagtgctttcaatcaagctattggtaacattacacagtcatttggtaaggttaatgatgctatacatcaaacatcacgaggtcttgctactgttgctaaagcattggcaaaagtgcaagatgttgtcaacatacaagggcaagctttaagccacctaacagtacaattgcaaaataatttccaagccattagtagttctattagtgacatttataataggcttgacgaattgagtgctgatgcacaagttgacaggctgatcacaggaagacttacagcacttaatgcatttgtgtctcagactctaaccagacaagcggaggttagggctagtagacaacttgccaaagacaaggttaatgaatgcgttaggtctcagtctcagagattcggattctgtggtaatggtacacatttgttttcactcgcaaatgcagcaccaaatggcatgattttctttcacacagtgctattaccaacggcttatgaaactgtgactgcttggccaggtatttgtgcttcagatggtgatcgcacttttggacttgtcgttaaagatgtccagttgactttgtttcgtaatctagatgacaagttctatttgacccccagaactatgtatcagcctagagttgcaactagttctgactttgttcaaattgaagggtgcgatgtgctgtttgttaatgcaactgtaagtgatttgcctagtattatacctgattatattgatattaatcagactgttcaagacatattagaaaattttagaccaaattggactgtacctgagttgacatttgacatttttaacgcaacctatttaaacctgactggtgaaattgatgacttagaatttaggtcagaaaagctacataacaccactgtagaacttgccattctcattgacaacattaacaatacattagtcaatcttgaatggctcaatagaattgaaacctatgtaaaatggccttggtatgtgtggctactaataggcttagtagtaatattttgcataccattactgctattttgctgttgtagtacaggttgctgtggatgcataggttgtttaggaagttgttgtcactctatatgtagtagaagacaatttgaaaattacgaaccaattgaaaaagtgcacgtccattaaatttaaaatgttaattctatcatctgctataatagcagttgtttctgctagagaattttgttaaggatgatgaataaagtctttaagaactaaacttacgagtcattacaggtcctgtatggacattgtcaaatccatttacacatccgtagatgctgtacttgacgaacttgattgtgcatactttgctgtaactcttaaagtagaatttaagactggtaaattacttgtgtgtataggttttggtgacacacttcttgctgctaaggataaagcatatgctaagcttggtctctccattattgaagaagtcaatagtcatatagttgtttaatatcattaaacacacaaaacccaaagcattaagtgttacaaaacaattaaagagagattatagaaaaactgtcattctaaattccatgcgaaaatgattggtggactttttcttagtactctgagttttgtaattgttagtaaccattctattgttaataacacagcaaatgtgcatcatatacaacaagaacgtgttatagtacaacagcatcatgttgttagtgctagaacacaaaactattacccagagttcagcatcgctgtactctttgtatcttttctagctttgtaccgtagtacaaactttaagacgtgtgtcggcatcttaatgtttaagattttatcaatgacacttttaggacctatgcttatagcatatggttactacattgatggcattgttacaacaactgtcttatctttaagatttgtctacttagcatacttttggtatgttaatagtaggtttgaatttattttatacaatacaacgacactcatgtttgtacatggcagagctgcaccgtttatgagaagttctcacagctctatttatgtcacattgtatggtggcataaattatatgtttgtgaatgacctcacgttgcattttgtagaccctatgcttgtaagcatagcaatacgtggcttagctcatgctgatctaactgtagttagagcagttgaacttctcaatggtgattttatttatgtattttcacaggagcccgtagtcggtgtttacaatgcagccttttctcaggcggttctaaacgaaattgacttaaaagaagaagaagaagaccatacctatgacgtttcctagggcattgactgtcatagatgacaatggaatggtcattaacatcattttctggttcctgttgataattatattgatattactttcaatagcattgctaaatataattaagctatgcatggtgtgttgcaatttaggaaggacagttattattgttccagcgcaacatgcttacgatgcctataagaattttatgcgaattaaagcatacaaccccgatggagcactccttgcttgaactaaacaaaatgaagattttgttaatattagcgtgtgtgattgcatgcgcatgtggagaacgctattgtgctatgaaatccgatacagatttgtcatgtcgcaatagtacagcgtctgattgtgagtcatgcttcaacggaggcgatcttatttggcatcttgcaaactggaacttcagctggtctataatattgatcgtttttataactgtgctacaatatggaagacctcaattcagctggttcgtgtatggcattaaaatgcttataatgtggctattatggcccgttgttttggctcttacgatttttaatgcatactcggaataccaagtgtccagatatgtaatgttcggctttagtattgcaggtgcaattgttacatttgtactctggattatgtattttgtaagatccattcagttgtacagaaggactaagtcttggtggtctttcaaccctgaaactaaagcaattctttgcgttagtgcattaggaagaagctatgtgcttcctctcgaaggtgtgccaactggtgtcactctaactttgctttcagggaatttgtacgctgaagggttcaaaattgcaggtggtatgaacatcgacaatttaccaaaatacgtaatggttgcattacctagcaggactattgtctacacacttgttggcaagaagttgaaagcaagtagtgcgactggatgggcttactatgtaaaatctaaagctggtgattactcaacagaggcaagaactgataatttgagtgagcaagaaaaattattacatatggtataactaaacttctaaatggccaaccagggacaacgtgtcagttggggagatgaatctaccaaaacacgtggtcgttccaattcccgtggtcggaagaataataacatacctctttcattcttcaaccccataaccctccaacaaggttcaaaattttggaacttatgtccgagagactttgtacccaaaggaataggtaacagggatcaacagattggttattggaatagacaaactcgctatcgcatggtgaagggccaacgtaaagagcttcctgaaaggtggttcttctactacttaggtactggacctcatgcagatgccaaatttaaagataaattagatggagttgtctgggttgccaaggatggtgccatgaacaaaccaaccacgcttggtagtcgtggtgctaataatgaatccaaagctttgaaattcgatggtaaagtgccaggcgaatttcaacttgaagttaatcaatcaagagacaattcaaggtcacgctctcaatctagatctcggtctagaaatagatctcaatctagaggcaggcaacaattcaataacaagaaggatgacagtgtagaacaagctgttcttgccgcacttaaaaagttaggtgttgacacagaaaaacaacagcaacgctctcgttctaaatctaaagaacgtagtaactctaagacaagagatactacacctaagaatgaaaacaaacacacctggaagagaactgcaggtaaaggtgatgtgacaagattttatggagctagaagcagttcagccaattttggtgacactgacctcgttgccaatgggagcagtgccaagcattacccacaactggctgaatgtgttccatctgtgtctagcattctgtttggaagctattggacttcaaaggaagatggcgaccagatagaagtcacgttcacacacaaataccacttgccaaaggatgatcctaagactggacaattccttcagcagattaatgcctatgctcgtccatcagaagtggcaaaagaacagagaaaaagaaaatctcgttctaaatctgcagaaaggtcagagcaagatgtggtacctgatgcattaatagaaaattatacagatgtgtttgatgacacacaggttgagataattgatgaggtaacgaactaaacgagatgctcgtcttcctccatgctgtatttattacagttttaatcttactactaattggtagactccaattattagaaagactattacttaatcactctttcaatcttaaaactgtcaatgactttaatatcttatataggagtttagcagaaaccagattactaaaagtggtgcttcgagtaatctttctagtcttactaggattttgctgctacagattgttagtcacattaatgtaaggcaacccgatgtctaaaactggtttttccgaggaattactggtcatcgcgctgtctactcttgtacagaatggtaagcacgtgtaataggaggtacaagcaaccctattgcatattaggaagtttagatttgatttggcaatgctagatttagtaatttagagaagtttaaagatccgctacgacgagccaacaatggaagagctaacgtctggatctagtgattgtttaaaatgtaaaattgtttgaaaattttccttttgatagtgatacaaaaaa

SEQ ID NO: 90 - DNA, 28586 bp, Coronavirus; identical to SEQ ID NO: 89

SEQ ID NO: 91 - DNA, 20600 bp, Coronavirus
acttttaaagtaaagtgagtgtagcgtggctatatctcttcttttactttaactagccttgtgctagattttgtcttcggacaccaactcgaactaaacgaaatatttgtctttctatgaaatcatagaggacaagcgttgattatttccattcagtttggcaatcactccttggaacggggttgagcgaacggtgcagtagggttccgtccctatttcgtaagtcgcctagtagtagcgagtgcggttccgcccgtacaacgttgggtagaccgggttccgtcctgtgatctccctcgccggccgccaggagaatgagttccaaacaattcaagatccttgttaatgaggactatcaagtcaacgtgcctagtcttcctattcgtgacgtgttacaggaaattaagtactgctaccgtaatggatttgagggctatgttttcgtaccagaatactgtcgtgacctagttgattgcgatcgtaaggatcactacgtcattggtgttcttggtaacggagtaagtgatcttaaacctgttcttcttaccgaaccctccgtcatgttgcaaggctttattgttagagctaactgcaatggcgttcttgaggactttgaccttaaaattgctcgcactggcagaggtgccatatatgttgatcaatacatgtgtggtgctgatggaaaaccagtcattgaaggcgattttaaggactacttcggtgatgaagacatcattgaatttgaaggagaggagtaccattgcgcttggacaactgtgcgcgatgagaaaccgctgaatcagcaaactctctttaccattcaggaaatccaatacaatctggacattcctcataaattgccaaactgtgctactagacatgtagcaccaccagtcaaaaagaactctaaaatagttctgtctgaagattacaagaagctttatgatatcttcggatcaccctttatgggaaatggtgactgtcttagcaaatgctttgacactcttcattttatcgctgctactcttagatgcccgtgtggttctgaaagtagcggcgttggagattggactggttttaagactgcctgttgtggtctttctggcaaagttaagggtgtcactttgggtgatattaagcctggtgatgctgttgtcactagtatgagcgcaggtaagggagttaagttctttgccaattgtgttcttcaatatgctggtgatgttgaaggtgtctccatctggaaagttattaaaacttttacagttgatgagactgtatgcacccctggttttgaaggcgaattgaacgacttcatcaaacctgagagcaaatcactagttgcatgcagcgttaaaagagcattcattactggtgatattgatgatgctgtacatgattgtatcattacaggaaaattggatcttagtaccaacctttttggtaatgttggtctattattcaagaagactccatggtttgtacaaaagtgtggtgcactttttgtagacgcttggaaagtagtagaggagctttgtggttcactcacacttacatacaagcaaatttatgaagttgtagcatcactttgcacttctgcttttacgattgtaaactacaagccaacatttgtggttccagacaatcgtgttaaagatcttgtagacaagtgtgtgaaagttcttgtaaaagcatttgatgtttttacgcagattatcacaatagctggtattgaggccaaatgctttgtgcttggtgctaaatacctgttgttcaataatgcacttgtcaaacttgtcagtgttaaaatccttggcaagaagcaaaagggtcttgaatgtgcattctttgctactagcttggttggtgcaactgttaatgtgacacctaaaagaacagagactgccactatcagcttgaacaaggttgatgatgttgtagcaccaggagagggttatatcgtcattgttggtgatatggctttctacaagagtggtgaatattatttcatgatgtctagtcctaattctgttcttactaacaatgtttttaaagcagttaaagttccatcttatgacatcgtttatgatgttgataatgataccaaaagcaaaatgattgcaaaacttggttcatcatttgaatatgatggtgatattgatgctgctattgtaaaagtcaatgaactactcattgaatttaggcagcaaagcttgtgcttcagagcttttaaggacgacaaaagcatttttgttgaagcctattttaaaaagtataaaatgccagcatgccttgcaaaacatattggtttgtggaacatcataaagaaagattcatgtaagaggggttttcttaatctcttcaatcacttgaatgaattggaagatatcaaagaaactaatattcaggctattaaaaacattctttgccctgatcctcttcttgatctggattatggtgccatttggtacaattgcatgccaggttgctctgatccttcagttttggggagtgttcaacttttgatcggtaatggtgtgaaagtagtttgtgatggctgcaaaggttttgctaaccaactttcaaaaggttacaacaagctctgtaacgcggctcgcaatgatattgagatcggtggtataccattttccacttttaaaacacctacaaatacttttattgaaatgacagatgctatctattcagttattgaacaaggtaaggcattatcctttagagatgctgatgtgccagttgtagacaatggtaccatttctactgctgattggtctgaacccattctgcttgaacctgctgaatatgtaaaaccaaagaacaatggtaatgtcattgttattgcaggttatacattttataaagatgaggatgaacatttttatccttatggttttggtaaaattgtgcagagaatgtataataaaatgggtggtggtgacaaaactgtctcattttcagaagaagtagatgttcaagaaattgcacctgttacacgtgttaaacttgaattcgaatttgacaatgaaattgtaactggtgttcttgaacgggctattggtactagatacaaatttactggtacaacttgggaagaatttgaagagtctatttctgaagaactcgatgcaatctttgatactctagcaaaccaaggtgtcgaacttgaaggttacttcatttatgacacttgtggtggctttgatataaaaaatccagatggtattatgatctctcagtatgatatcaatattactgctgatgaaaaatcagaagttagtgcatcaagtgaagaagaagaagttgaatctgttgaagaagatcctgagaatgaaattgtagaagcatctgaaggtgctgaagggacttcttctcaagaagaggttgaaacagtagaagttgcagatattacttctacagacgaagatgttgacattgttgaagtatctgctaaagatgacccttgggctgcagctgttgatgtacaagaagctgaacaatttaatccttctctaccacctttcaagacaacgaatctcaacggaaaaattatccttaagcaaggggataataattgttggataaatgcttgttgctatcagcttcaggcctttgattttttcaacaatgaagcttgggagaaatttaagaaaggtgatgtcatggactttgtaaacctttgttatgcagcaacaacactagcaagaggtcattctggtgatgcagagtatcttcttgaacttatgctcaatgattatagcacagccaagatagtacttgcagctaagtgtggttgtggtgaaaaagaaattgttttggaaagagctgtttttaaactcaccccacttaaggagagttttaattatggtgtttgtggtgactgcatgcaagttaacacctgtagatttttaagtgttgaaggctctggtgtttttgttcatgacatattaagcaagcaaacgccagaagctatgtttgttgtcaaacctgttatgcatgcagtttacactggcacaactcaaaatggccattacatggttgatgatattgaacacggttattgtgtagatggtatgggtattaaaccacttaagaaacggtgttatacatccacattgttcattaatgccaatgtaatgactagagctgaaaaaccaaaacaagagtttaaagttgaaaaagtagaacagcaaccgatagtggaggaaaacaaatcctctattgaaaaagaggaaattcaaagtcctaaaaacgatgaccttatacttccattttacaaagctggtaaactttccttttatcagggtgctttggatgttttgatcaatttcttggaacctgatgttattgttaatgctgctaatggtgatcttaaacacatgggtggtgtcgcaagagccatcgatgttttcactggtggcaaattaacagaacgttctaaggattatcttaaaaagaacaaatctattgctcctggtaatgctgttttctttgaaaatgtcattgagcatcttagtgttttgaatgcagttggaccacgtaatggtgacagccgagttgaagccaaactttgtaatgtttacaaagcaattgcaaagtgtgaaggaaaaatattaacaccacttattagtgttggtatctttaatgttagacttgaaacatcattgcagtgcttacttaagactgtgaatgacaggggattgaatgtcttcgtatacactgaccaggagaggcaaactattgagaatttcttctcttgttctatccctgtcaatgttactgaggataatgttaaccatgaacgtgtgtctgtttcttttgacaaaacatacggtgaacagcttaagggcaccgttgtcatcaaagacaaagatgttacaaaccagttgcctagcgcttttgatgttggtcaaaaagttattaaggctattgatatagattggcaagctcattatggtttccgtgatgctgctgcttttagcgctagtagtcatgatgcttataaatttgaagttgttacacatagcaatttcattgtgcataagcagactgacaacaactgttggattaatgcaatttgtcttgcattacagagactcaagccacagtggaaatttcctggtgttagaggtctctggaatgaatttcttgagcgtaaaacacaaggttttgtacatatgttgtatcacatttctggagtaaagaaaggtgagccaggtgatgctgaattaatgctgcataaacttggtgacttgatggacaatgattgtgaaatcattgtcacacacactacagcatgtgacaagtgcgcaaaagtagaaaagtttgttggaccagtggtagcagcacctcttgcaattcatggcactgacgaaacatgtgtgcatggcgttagtgtcaatgtcaaagtcacccaaattaagggcactgttgctattacttctttgattggtcctattattggagaagtactagaagcaactggttatatttgttatagcggttctaacaggaatggtcattacacctattacgataaccgtaatggattagtggttgatgcagaaaaggcttaccattttaatagagacttattacaggtcacaacagctattgcaagtaatttcgttgtcaagaaaccacaagcagaggaaagacctaagaattgtgcttttaacaaagttgcagcatctcctaagattgtacaagaacaaaaattgttggctattgaaagtggtgctaactatgctcttactgaatttggaagatatgctgacatgttctttatggctggagataaaattcttaggttgctgcttgaagtctttaaatatttgctggttttatttatgtgtcttagaagtactaagatgcctaaagttaaagtcaaaccacctcttgcatttaaagattttggtgctaaggtcagaacgctcaattacatgagacaattgaacaaaccctctgtctggcgttacgcaaaactagttttattgttgatagcaatatataatttcttttatttgtttgtcagtataccagtagtgcataaattaacatgtaacggtgctgtacaggcatataaaaattctagttttataaagtctgcagtctgtggcaactctattttatgcaaagcctgtttggcttcttatgatgagttggctgattttcaacatctccaagttacttgggatttcaaatctgacccactatggaacagactggtacaattgtcttactttgcattcttggctgtttttggtaataactatgttaggtgttttcttatgtattttgtatctcagtacctcaacctttggctttcttattttggttatgtagagtacagttggtttttgcatgttgtcaactttgaatccatctcagctgagtttgtgatcgtagttatagtggttaaggcagttctcgcccttaaacatattgttttcgcatgctcaaacccgtcttgcaaaacgtgctctaggactgcaaggcagacacgtattcctattcaagttgttgttaatggttcaatgaagactgtttatgttcatgctaatggtactggtaaattctgcaagaaacacaatttttattgtaagaactgtgattcttatggctttgaaaacacattcatctgtgacgaaattgtacgtgatctcagtaatagtgttaaacaaactgtttacgccactgatagatctcatcaagaagtcacaaaagttgaatgttcagatggcttttacagattttatgttggtgatgaattcacttcatatgactatgatgtaaaacacaagaaatacagtagtcaagaggttctcaagagcatgctcttgcttgatgacttcattgtgtacagtccatctggttctgctcttgcaaatgttagaaatgcctgtgtttatttttcacaacttattggtaagcctattaagattgttaacagtgatttgcttgaagacctctctgtagattttaaaggggcactttttaatgctaaaaagaatgtaattaagaattctttcaatgttgatgtctcagaatgcaaaaatcttgacgaatgttacagggcttgcaatcttaatgtttcattttctacatttgaaatggctgtcaacaatgctcataggtttggtattctgattactgatcgttcttttaacaatttctggccatcaaaagttaagcctggttcatctggtgtgtcggccatggacattggtaagtgtatgacttctgatgctaagattgttaatgctaaagttttaactcaacgtggtaaaagtgttgtttggcttagccaggattttgctgcacttagctcaactgctcagaaagttttggttaaaacttttgtagaagaaggtgtcaacttttcactcacatttaatgctgtaggttcagatgatgatcttacttatgaaagattcactcaatctgtgtctccaaaaagtggctcaggctttttcgatgtaattacacagcttaaacaaattgtgattttggtttttgtttttatctttatttgtggtttgtgctctgtttacagtgttgctacacagtcctacattgaatctgctgaaggctatgactacatggttattaagaatggaattgttcaaccttttgacgataccatttcatgtgttcataacacttataaaggattcggtgactggtttaaagctaagtatggttttatccctacttttggtaaatcatgtccaattgttgtaggaactgtttttgatcttgaaaatatgagaccaattcctgacgtgcctgcatatgtttctattgtgggtagatctcttgttttcgctattaatgctgcttttggtgttactaatatgtgctatgatcatactggcaatgcagttagtaaggactcttactttgatacttgtgtgtttaatactgcgtgcaccactcttacaggtcttggtggtacaattgtatattgtgcaaagcaaggtttagttgaaggtgctaagctctatagtgatcttatgccagactattattatgagcatgctagtggtaacatggttaaattgccagcaattattagaggacttggtctacgttttgtgaaaacacaggctacaacttattgtagagtgggagagtgcattgatagtaaagctggtttttgctttggtggcgataactggtttgtctacgacaatgagtttggcaatggatacatctgtggtaattctgtgctaggattctttaagaatgtcttcaaactctttaactctaacatgtctgtggtagctacatctggtgcgatgcttgttaacattattattgcatgcttagctattgcaatgtgttatggtgttcttaagtttaagaagatttttggtgattgtactttcctcattgttatgatcattgtcacccttgttgtgaacaatgtgtcttattttgtcactcaaaacacgttctttatgatcatctacgccattgtttactattttataacaagaaaacttgcatacccaggcattcttgatgctgggtttattattgcttatattaatatggctccatggtacgtgattaccgcatatatcctagttttcctctatgactcactcccttcactgtttaaacttaaagtttcaacaaatctttttgaaggtgataaatttgtgggtaactttgaatctgctgctatgggtacttttgttattgacatgcgttcatatgaaactattgttaattctacttctattgctagaattaaatcatatgctaacagcttcaataaatataagtactacacaggttcaatgggagaagctgactacagaatggcttgctatgctcatcttggtaaagctcttatggactattctgttaatagaacagacatgctttacacacctcctactgttagtgttaattctacacttcagtcaggtttgcggaaaatggcacagcctagtggtcttgtagagccttgcattgtaagagtttcctatggtaacaatgtgcttaatggtttatggttaggagatgaagtcatttgccctagacatgttattgctagtgataccacacgtgttatcaactatgaaaatgaaatgtctagtgtgagacttcacaacttttcagtttctaagaataatgtgtttttgggtgttgtgtctgccagatataagggtgtgaatcttgtacttaaagtcaaccaggttaatcctaacacaccagaacataaatttaagtctattaaagctggtgaaagttttaacattcttgcttgttatgaaggatgtcctggcagtgtttatggtgtcaacatgagaagtcaaggtaccattaaaggatcttttatagctggtacttgtggatcagtaggttatgtgttagaaaatggaattctctattttgtatacatgcatcacttagaacttggaaatggctcgcatgttggttccaattttgaaggagaaatgtacggtggttatgaagatcaacctagcatgcaattggaaggtactaatgtcatgtcatcagataatgtggttgcattcctatatgctgcacttatcaatggtgaaaggtggtttgttacaaacacatcgatgtcattagaatcatacaatacatgggccaaaactaacagtttcacagaactttcttcaactgatgcttttagcatgttggctgcaaaaactggtcaaagtgttgagaaattactagatagcatcgtaagactcaacaagggttttggaggtcgtactatactttcttatggctcattgtgtgacgagttcactccaactgaagtcataaggcaaatgtatggtgtaaatcttcaggctggtaaagtaaaatctttcttctaccctattatgactgcaatgacaattctctttgccttttggcttgaattctttatgtacacacccttcacttggattaatccaacttttgttagcattgtattggctgttacaactttgatctcgacggtttttgtctctggcatcaaacataagatgttgttctttatgtcttttgtccttcctagtgttatccttgtgacagcacacaatttgttctgggacttttcttactatgaaagtcttcagtcaattgttgagaatactaacactatgtttttgcctgttgacatgcaaggtgtcatgctcacagtgttttgctttattgtctttgttacatatagtgttagattcttcacttgcaaacaatcatggttctcacttgctgtgacaactattcttgtgatctttaacatggttaaaatctttggaacatctgatgaaccatggactgaaaaccaaattgctttctgctttgtgaacatgcttactatgattgtcagtcttactacaaaggattggatggttgtcattgcatcatacagaattgcatattatattgttgtatgtgtaatgccatctgcttttgtatctgactttgggtttatgaagtgtattagcattgtttacatggcgtgcggttatttgttttgttgctattatggcattctttattgggttaacagatttacatgcatgacttgtggtgtttatcaattcactgtgtctgcagctgaacttaaatacatgaccgctaacaacctttctgcacctaagaacgcatatgacgctatgattcttagtgctaaattgattggtgttggaggtaagagaaacatcaaaatttcaactgtacagtcaaaacttacagagatgaaatgtaccaatgttgtcttgcttggtcttttatctaaaatgcatgtcgagtctaactcaaaagagtggaactattgtgttggactacacaatgagataaacctttgtgacgatcctgaaatcgttcttgagaaactgttagctcttattgcattcttcttgtccaaacataacacttgtgaccttagcgaacttattgaatcatactttgagaacaccaccatactccagagtgtggcttcagcttatgctgcattgcctagctggattgcacttgaaaaagctcgcgctgatcttgaagaggctaagaaaaatgatgttagccctcaaattttgaagcagcttactaaagcatttaacattgccaagagtgattttgagcgcgaagcatcagtgcaaaagaaactcgacaaaatggctgagcaggctgcagctagtatgtataaagaagcacgagctgtggacagaaagtcaaagattgtttctgctatgcatagcctactttttggtatgcttaagaaacttgatatgtccagtgtcaacactattattgaccaggctcgtaatggtgttctacctttaagtatcattccagctgcatcagctacaagacttgttgttattacacctagccttgaagtgttttccaagattaggcaagaaaacaatgttcattatgctggtgctatttggactattgttgaagttaaagatgctaatggttcacatgtacatcttaaggaagttaccgctgctaatgaattaaaccttacttggccattgagcattacttgtgagagaaccacaaagcttcagaacaatgaaattatgccaggtaaacttaaagaaagagctgtcagagcgtcagcaactcttgatggtgaagctttcggcagtggaaaggctcttatggcatctgaaagtggaaaaagctttatgtatgcatttatagcctcagacaacaatcttaagtatgttaagtgggagagcaataatgatattatacctattgaacttgaagctccattgcgtttctatgttgacggcgctaatggtcctgaagtcaagtatttgtattttgtcaagaatttaaacactcttagacgtggtgccgttcttggttatatcggtgcaacagttcgtctgcaagctggtaaacccactgaacatccatctaacagtagtttattgacattgtgtgctttttcacctgatcctgctaaagcatatgttgatgctgttaagagaggcatgcaaccagttaataactgtgtaaaaatgctctcaaatggtgctggtaatggtatggctgttacaaacggtgtcgaagctaacacacaacaggactcttatggtggtgcttcagtttgtatttattgcagatgccatgttgaacatcctgctattgatggattatgccgctacaaaggtaagttcgtgcaaataccaactggcacacaagatccaattcggttctgtattgaaaatgaagtttgtgttgtctgtggttgttggcttaacaatggttgcatgtgcgatcgtacttctatgcagagttttactgttgatcaaagttatttaaacgagtgcggggttctagtgcagctcgactagaaccctgcaatggtactgatccagaccatgttagtagagcttttgacatctacaacaaagatgttgcgtgtattggtaaattccttaagacgaattgttcaagatttaggaatttggacaaacatgatgcctactacattgtcaaacgttgtacaaagaccgttatggaccatgagcaagtctgttataacgatcttaaagattctggtgctgttgctgagcatgacttcttcacatataaagagggtagatgtgagttcggtaatgttgcacgtaggaatcttacaaagtacacaatgatggatctttgttacgctatcagaaattttgatgaaaagaactgtgaagttctcaaagaaatactcgtgacagtaggtgcttgcactgaagaattctttgaaaataaagattggtttgatccagttgaaaatgaagccatacatgaagtttatgcaaaacttggacccattgtagccaatgctatgcttaaatgtgttgctttttgcgatgcgatagtggaaaaaggctatataggtgttataacacttgacaaccaagatcttaatggcaatttctacgatttcggcgatttcgtgaagactgctccgggttttggttgcgcttgtgttacatcatattattcttatatgatgcctttaatggggatgacttcatgcttagagtctgaaaactttgtgaaaagtgacatctatggttctgattataagcagtatgatttactagcttatgattttaccgaacataaggagtaccttttccaaaaatactttaagtactgggatcgcacatatcacccaaattgttctgattgtactagtgacgagtgtattattcattgtgctaattttaacacattgttttctatgacaataccaatgacagcttttggaccacttgtccgtaaagttcatattgatggtgtaccagtagttgttactgcaggttaccatttcaaacaacttggtatagtatggaatcttgatgtaaaattagacacaatgaagttgagcatgactgatcttcttagatttgtcacagatccaacacttcttgtagcatcaagccctgcacttttagaccagcgtactgtctgtttctccattgcagctttgagtactggtattacatatcagacagtaaaaccaggtcactttaacaaagatttctacgatttcataacagagcgtggattctttgaagagggatctgagttaacattaaaacattttttctttgcacagggtggtgaagctgctatgacagacttcaattattatcgctacaatagagtcacagtacttgatatttgccaagctcaatttgtttacaaaatagttggcaagtattttgaatgttatgacggtgggtgcattaatgctcgtgaagttgttgttacaaactatgacaagagtgctggctatcctttgaacaaatttggtaaagctagactttactacgaaactctttcatatgaagagcaggatgcactttttgctttaacaaagagaaatgttttacccacaatgactcaaatgaatttgaaatacgctatttctggtaaggcaagagctcgtacagtaggaggagtttcacttctttctaccatgactacgagacaatatcatcagaagcatttgaagtcaattgctgcaacacgcaatgctactgtggtcattggttcaaccaagttttatggtggttgggacaatatgcttaaaaatttaatgcgtgatgttgataatggttgtttgatgggatgggactatcctaagtgtgaccgtgctttacctaatatgattagaatggcttctgccatgatattaggttctaagcatgttggttgttgtacacataatgataggttctaccgcctctccaatgagttagctcaagtactcacagaagttgtgcattgcacaggtggtttttattttaaacctggtggtacaactagcggtgatggtactacagcatatgctaactctgcttttaacatctttcaagctgtttctgctaatgttaataagcttttgggggttgattcaaacgcttgtaacaacgttacagtaaaatccatacaacgtaaaatttacgataattgttatcgtagtagcagcattgatgaagaatttgttgttgagtactttagttatttgagaaaacacttttctatgatgattttatctgatgatggagttgtgtgctacaacaaagattatgcggatttaggttatgtagctgacattaatgcttttaaagcaacactttattaccagaataacgtctttatgtccacttctaagtgttgggtagaaccagatcttagtgttggaccacatgaattttgttcacagcatacattgcagattgttgggcctgatggagactactatcttccctatccagacccgtccagaattttatcagctggtgtgtttgttgatgacatagttaaaacagacaatgttattatgttagaacgttacgtgtcattggctattgacgcatacccgctcacaaaacaccctaagcctgcttatcaaaaagtgttttacactctactagattgggttaaacatctacagaaaaatttgaatgcaggtgttcttgattcgttttcagtgacaatgttagaggaaggtcaagataagttctggagtgaagagttttacgctagcctctatgaaaagtccactgtcttgcaagctgcaggcatgtgtgtagtatgtggttcgcaaactgtacttcgttgtggagactgtcttaggagaccacttttatgcacgaaatgtgcttacgaccatgttatgggaacaaagcataaattcattatgtctatcacaccatatgtgtgtagttttaatggttgtaatgtcaatgatgttacaaagttgtttttaggtggtcttagttattattgtatgaaccacaaaccacagttgtcattcccactctgtgctaatggcaacgtttttggtctatataaaagtagtgcagtcggctcagaggctgttgaagatttcaacaaacttgcagtttctgactggactaatgtagaagactacaaacttgctaacaatgtcaaggaatctctgaaaattttcgctgctgaaactgtgaaagctaaggaggagtctgttaaatctgaatatgcttatgctgtattaaaggaggttatcggccctaaggaaattgtactccaatgggaagcttctaagactaagcctccacttaacagaaattcagttttcacgtgttttcagataagtaaggatactaaaattcaattaggtgaatttgtgtttgagcaatctgagtacggtagtgattctgtttattacaagagcacgagtacttacaaattgacaccaggtatgatttttgtgttgacttctcataatgtgagtcctcttaaagctccaattttagtcaaccaagaaaagtacaataccatatctaagctctatcctgtctttaatatagcggaggcctataatacactggttccttactaccaaatgataggtaagcaaaaatttacaactatccaaggtcctcctggtagcggtaaatctcattgtgttataggtttgggtttgtattaccctcaggcgagaatagtctacactgcatgttctcatgcggctgtagacgctttatgtgaaaaagcagccaaaaacttcaatgttgatagatgttcaaggataatacctcaaagaatcagagttgattgttacacaggctttaaggctaataacaccaatgcgcagtacttgttttgtactgttaatgctctaccagaagcaagttgtgacattgttgtagttgatgaggtctctatgtgtactaattatgatcttagtgtcataaatagccgactgagttacaaacatattgtttatgttggagacccacagcagctaccagctcctagaactttgattaataagggtgtacttcaaccgcaggattacaatgttgtaaccaaaagaatgtgcacactaggacctgatgtctttttgcataaatgttacaggtgcccagctgaaattgttaagacagtctctgcacttgtttatgaaaataaatttgtacctgtcaacccagaatcaaagcagtgcttcaaaatgtttgtaaaaggtcaggttcagattgagtctaactcttctataaacaacaagcaactagaggttgtcaaggcctttttagcacataatccaaaatggcgtaaagctgttttcatctcaccctataatagtcaaaattatgttgctcggcgtcttcttggtttgcaaacgcaaactgtggattccgctcagggtagtgagtatgattacgtcatctacacacagacctccgatacacagcatgctactaatgttaacagatttaatgttgccattacgagagcaaaggttggtatactttgtatcatgtgtgatagaactatgtatgagaatcttgatttctatgaactcaaagattcaaagattggtttacaagcaaaacctgaaacttgtggtttatttaaagattgttcgaagagcgaacaatacataccacctgcttatgcaacgacatatatgagcttatctgataattttaagacaagtgatggtttagctgttaacatcggtacaaaagatgttaaatatgctaatgtcatctcatatatgggattcaggtttgaagccaacataccaggctatcacacactattctgcacgcgagattttgctatgcgtaatgttagagcatggcttgggtttgacgttgaaggtgcacatgtctgtggtgataatgttggaactaatgtaccattacagctgggtttctcaaacggtgtggattttgtagtgcaaactgaaggatgtgttattactgaaaaaggtaatagcattgaggttgtaaaagcacgagcaccaccaggtgagcaatttgcacacttgattccgcttatgagaaagggtcaaccttggcacattgttagacgccgtatagtgcagatggtctgtgactattttgatggcttatcagacattctgatctttgtgctttgggctggtggtcttgaacttacaactatgagatactttgttaaaattggaagaccacaaaaatgtgaatgcggcaaaagtgcaacttgttatagtagctctcaatctgtttatgcttgcttcaagcatgcattaggatgtgattatttatataacccttactgcattgacatacagcaatggggttacacaggatctttgagcatgaatcatcatgaagtttgcaacattcatagaaatgagcatgtagctagtggtgatgctatcatgactagatgtctcgctatacatgactgttttgtcaaacgtgttgattggtcaattgtgtacccttttattgacaatgaagaaaagatcaataaagctggtcgcatagtgcagtcacatgtcatgaaagctgctctgaagatttttaatcctgctgcaattcacgatgtgggtaatccaaaaggcatccgttgtgctacaacaccaataccatggttttgttatgatcgtgatcctattaataacaatgttagatgtctggattatgactatatggtacatggtcaaatgaatggtcttatgttattttggaactgtaatgtagacatgtacccagagttttcaattgtttgtagatttgatactcgcactcgctctaaattgtctttagaaggttgtaatggtggtgcattgtatgttaataaccatgctttccacacaccagcttatgatagaagagcttttgctaagcttaaacctatgccattcttttactatgatgatagtaattgtgaacttgttgatgggcaacctaattatgtaccacttaagtcaaatgtttgcataacaaaatgcaacattggtggtgctgtctgcaagaagcatgctgctctttacagagcgtatgttgaggattacaacatttttatgcaggctggttttacaatatggtgtcctcaaaactttgacacctatatgctttggcatggttttgttaatagcaaagcacttcagagtctagaaaatgtggcttttaatatcgttaagaaaggtgccttcaccggtttaaaaggtgacttaccaactgctgttattgctgacaaaataatggtaagagatggacctactgacaaatgtatttttacaaataagactagtttacctacaaatgtagcttttgagttatatgcaaaacgcaaacttggactcacacctccattaacaatacttaggaatttaggtgttgtcgcaacatataagtttgtgttgtgggattatgaagctgaacgtcctttctcaaatttcactaagcaagtgtgttcctacactgatcttgatagtgaagttgtaacatgttttgataatagtattgctggttcttttgagcgttttactactacaagagatgcagtgcttatttctaataacgctgtgaaagggcttagtgccattaaattacaatatggccttttgaatgatctacctgtaagtactgttggaaataaacctgtcacatggtatatctatgtgcgcaagaatggtgagtacgtcgaacaaatcgatagttactatacacagggacgtacttttgaaaccttcaaacctcgtagtacaatggaagaagattttcttagtatggatactacactcttcatccaaaagtatggtcttgaggattatggttttgaacacgttgtatttggagatgtctctaaaactaccattggtggtatgcatcttcttatatcgcaagtgcgccttgcaaaaatgggtttgttttccgttcaagaatttatgaataattctgacagtacactgaaaagttgttgtattacatatgctgatgatccatcttctaagaatgtgtgcacttatatggacatactcttggacgattttgtgactatcattaagagcttagatcttaatgttgtgtccaaagttgtggatgtcattgtagattgtaaggcatggagatggatgttgtggtgtgagaattcacatattaaaaccttctatccacaactccaatctgctgaatggaatcccggctatagcatgcctacactgtacaaaatccagcgtatgtgtctcgaacggtgtaatctctacaattatggtgcacaagtgaaattacctgtaggcattactactaagttcgttaagtatactcagttgtgtcaataccttaacactactacattgtgtgtaccacacaaaatgcgtgtattgcatttaggagctgctggtgcatctggtgttgctcctggtagtactgtattaagaagatggttaccagatgatgccatattggttgataatgatttgagagattacgtttccgacgcagacttcagtgttacaggtgattgtactagtctttacatcgaagacaagtttgatttgctcgtctctgatttatatgatggctccacaaaatcaattgacggtgaaaacacgtcgaaagatggtttctttacttatattaatggtttcattaaagagaaactgtcacttggtggatctgttgccattaaaatcacggaatttagttggaataaagatttatatgaattgattcaaagatttgagtattggactgtgttttgtacaagtgttaacacgtcatcatcagaaggctttctgattggtattaactacttaggaccatactgtgacaaagcaatagtagatggaaatataatgcatgccaattatatattttggagaaactctacaattatggctctatcacataactcagtcctagacactcctaaattcaagtgtcgttgtaacaacgcacttattgttaatttaaaagaaaaagaattgaatgaaatggtcattggattactaaggaagggtaagttgctcattagaaataatggtaagttactaaactttggtaacacttcgttaacacaccatgaaaaaactatttgtggttttggtcgtaatgccattgatttatggagacaattttccttgttctaaattgactaatagaactataggcaaccagtggaatctcattgaaaccttccttctaaactatagtagtaggttaccacctaattcagatgtggtgttaggtgattattttcctactgtacaaccttggtttaattgcattcgcaataatagtaatgacctttatgttaca

SEQ ID NO: 92 - DNA, 9714 bp, Coronavirus
acttttaaagtaaagtgagtgtagcgtggctatatctcttcttttactttaactagccttgtgctagattttgtcttcggacaccaactcgaactaaacgaaatatttgtctttctatgaaatcatagaggacaagcgttgattatttccattcagtttggcaatcactccttggaacggggttgagcgaacggtgcagtagggttccgtccctatttcgtaagtcgcctagtagtagcgagtgcggttccgcccgtacaacgttgggtagaccgggttccgtcctgtgatctccctcgccggccgccaggagaatgagttccaaacaattcaagatccttgttaatgaggactatcaagtcaacgtgcctagtcttcctattcgtgacgtgttacaggaaattaagtactgctaccgtaatggatttgagggctatgttttcgtaccagaatactgtcgtgacctagttgattgcgatcgtaaggatcactacgtcattggtgttcttggtaacggagtaagtgatcttaaacctgttcttcttaccgaaccctccgtcatgttgcaaggctttattgttagagctaactgcaatggcgttcttgaggactttgaccttaaaattgctcgcactgtcagaggtgccatatatgttgatcaatacatgtgtggtgctgatggaaaaccagtcattgaaggcgattttaaggactacttcggtgatgaagacatcattgaatttgaaggagaggagtaccattgcgcttggacaactgtgcgcgatgagaaaccgctgaatcagcaaactctctttaccattcaggaaatccaatacaatctggacattcctcataaattgccaaactgtgctactagacatgtagcaccaccagtcaaaaagaactctaaaatagttctgtctgaagattacaagaagctttatgatatcttcggatcaccctttatgggaaatggtgactgtcttagcaaatgctttgacactcttcattttatcgctgctactcttagatgcccgtgtggttctgaaagtagcggcgttggagattggactggttttaagactgcctgttgtggtctttctggcaaagttaagggtgtcactttgggtgatattaagcctggtgatgctgttgtcactagtatgagcgcaggtaagggagttaagttctttgccaattgtgttcttcaatatgctggtgatgttgaaggtgtctccatctggaaagttattaaaacttttacagttgatgagactgtatgcacccctggttttgaaggcgaattgaacgacttcatcaaacctgagagcaaatcactagttgcatgcagcgttaaaagagcattcattactggtgatattgatgatgctgtacatgattgtatcattacaggaaaattggatcttagtaccaacctttttggtaatgttggtctattattcaagaagactccatggtttgtacaaaagtgtggtgcactttttgtagacgcttggaaagtagtagaggagctttgtggttcactcacacttacatacaagcaaatttatgaagttgtagcatcactttgcacttctgcttttacgattgtaaactacaagccaacatttgtggttccagacaatcgtgttaaagatcttgtagacaagtgtgtgaaagttcttgtaaaagcatttgatgtttttacgcagattatcacaatagctggtattgaggccaaatgctttgtgcttggtgctaaatacctgttgttcaataatgcacttgtcaaacttgtcagtgttaaaatccttggcaagaagcaaaagggtcttgaatgtgcattctttgctactagcttggttggtgcaactgttaatgtgacacctaaaagaacagagactgccactatcagcttgaacaaggttgatgatgttgtagcaccaggagagggttatatcgtcattgttggtgatatggctttctacaagagtggtgaatattatttcatgatgtctagtcctaattttgttcttactaacaatgtttttaaagcagttaaagttccatcttatgacatcgtttatgatgttgataatgataccaaaagcaaaatgattgcaaaacttggttcatcatttgaacaaataccaactggcacacaagatccaattcggttctgtattgaaaatgaagtttgtgttgtctgtggttgttggcttaacaatggttgcatgtgcgatcgtacttctatgcagagttttactgttgatcaaagttatttaaacgagtgcggggttctagtgcagctcgactagaaccctgcaatggtactgatccagaccatgttagtagagcttttgacatctacaacaaagatgttgcgtgtattggtaaattccttaagacgaattgttcaagatttaggaatttggacaaacatgatgcctactacattgtcaaacgttgtacaaagaccgttatggaccatgagcaagtctgttataacgatcttaaagattctggtgctgttgctgagcatgacttcttcacatataaagagggtagatgtgagttcggtaatgttgcacgtaggaatcttacaaagtacacaatgatggatctttgttacgctatcagaaattttgatgaaaagaactgtgaagttctcaaagaaatactcgtgacagtaggtgcttgcactgaagaattctttgaaaataaagattggtttgatccagttgaaaatgaagccatacatgaagtttatgcaaaacttggacccattgtagccaatgctatgcttaaatgtgttgctttttgcgatgcgatagtggaaaaaggctatataggtgttataacacttgacaaccaagatcttaatggcaatttctacgatttcggcgatttcgtgaagactgctccgggttttggttgcgcttgtgttacatcatattattcttatatgatgcctttaatggggatgacttcatgcttagagtctgaaaactttgtgaaaagtgacatctatggttctgattataagcagtatgatttactagcttatgattttaccgaacataaggagtaccttttccaaaaatactttaagtactgggatcgcacatatcacccaaattgttctgattgtactagtgacgagtgtattattcattgtgctaattttaacacattgttttctatgacaataccaatgacagcttttggaccacttgtccgtaaagttcatattgatggtgtaccagtagttgttactgcaggttaccatttcaaacaacttggtatagtatggaatcttgatgtaaaattagacacaatgaagttgagcatgactgatcttcttagatttgtcacagatccaacacttcttgtagcatcaagccctgcacttttagaccagcgtactgtctgtttctccattgcagctttgagtactggtattacatatcagacagtaaaaccaggtcactttaacaaggatttctacgatttcataacagagcgtggattctttgaagagggatctgagttaacattaaaacattttttctttgcacagggtggtgaagctgctatgacagacttcaattattatcgctacaatagagtcacagtacttgatatttgccaagctcaatttgtttacaaaatagttggcaagtattttgaatgttatgacggtgggtgcattaatgctcgtgaagttgttgttacaaactatgacaagagtgctggctatcctttgaacaaatttggtaaagctagactttactacgaaactctttcatatgaagagcaggatgcactttttgctttaacaaagagaaatgttttacccacaatgactcaaatgaatttgaaatacgctatttctggtaaggcaagagctcgtacagtaggaggagtttcacttctttctaccatgactacgagacaatatcatcagaagcatttgaagtcaattgctgcaacacgcaatgctactgtggtcattggttcaaccaagttttatggtggttgggacaatatgcttaaaaatttaatgcgtgatgttgataatggttgtttgatgggatgggactatcctaagtgtgaccgtgctttacctaatatgattagaatggcttctgccatgatattaggttctaagcatgttggttgttgtacacataatgataggttctaccgcctctccaatgagttagctcaagtactcacagaagttgtgcattgcacaggtggtttttattttaaacctggtggtacaactagcggtgatggtactacagcatatgctaactctgcttttaacatctttcaagctgtttctgctaatgttaataagcttttgggggttgattcaaacgcttgtaacaacgttacagtaaaatccatacaacgtaaaatttacgataattgttatcgtagtagcagcattgatgaagaatttgttgttgagtactttagttatttgagaaaacacttttctatgatgattttatctgatgatggagttgtgtgctacaacaaagattatgcggatttaggttatgtagctgacattaatgcttttaaagcaacactttattaccagaataacgtctttatgtccacttctaagtgttgggtagaaccagatcttagtgttggaccacatgaattttgttcacagcatacattgcagattgttgggcctgatggagactactatcttccctatccagacccgtccagaattttgtcagctggtgtgtttgttgatgacatagttaaaacagacaatgttattatgttagaacgttacgtgtcattggctattgacgcatacccgctcacaaaacaccctaagcctgcttatcaaaaagtgttttacactctactagattgggttaaacatctacagaaaaatttgaatgcaggtgttcttgattcgttttcagtgacaatgttagaggaaggtcaagataagttctggagtgaagagttttacgctagcctctatgaaaagtccactgtcttgcaagctgcaggcatgtgtgtagtatgtggttcgcaaactgtacttcgttgtggagactgtcttaggagaccacttttatgcacgaaatgtgcttacgaccatgttatgggaacaaagcataaattcattatgtctatcacaccatatgtgtgtagttttaatggttgtaatgtcaatgatgttacaaagttgtttttaggtggtcttagttattattgtatgaaccacaaaccacagttgtcattcccactctgtgctaatggcaacgtttttggtctatataaaagtagtgcagtcggctcagaggctgttgaagatttcaacaaacttgcagtttctgactggactaatgtagaagactacaaacttgctaacaatgtcaaggaatctctgaaaattttcgctgctgaaactgtgaaagctaaggaggagtctgttaaatctgaatatgcttatgctgtattaaaggaggttatcggccctaaggaaattgtactccaatgggaagcttctaagactaagcctccacttaacagaaattcagttttcacgtgttttcagataagtaaggatactaaaattcaattaggtgaatttgtgtttgagcaatctgagtacggtagtgattctgtttattacaagagcacgagtacttacaaattgacaccaggtatgatttttgtgttgacttctcataatgtgagtcctcttaaagctccaattttagtcaaccaagaaaagtacaataccatatctaagctctatcctgtctttaatatagcggaggcctataatacactggttccttactaccaaatgataggtaagcaaaaatttacaactatccaaggtcctcctggtagcggtaaatctcattgtgttataggtttgggtttgtattaccctcaggcgagaatagtctacactgcatgttctcatgcggctgtagacgctttatgtgaaaaagcagccaaaaacttcaatgttgatagatgttcaaggataatacctcaaagaatcagagttgattgttacacaggctttaagcctaataacaccaatgcgcagtacttgttttgtactgttaatgctctaccagaagcaagttgtgacattgttgtagttgatgaggtctctatgtgtactaattatgatcttagtgtcataaatagccgactgagttacaaacatattgtttatgttggagacccacagcagctaccagctcctagaactttgattaataagggtgtacttcaaccgcaggattacaatgttgtaaccaaaagaatgtgcacactaggacctgatgtctttttgcataaatgttacaggtgcccagctgaaattgttaaaacagtctctgcacttgtttatgaaaataaatttgtacctgtcaacccagaatcaaagcagtgcttcaaaatgtttgtaaaaggtcagattcagattgagtctaactcttctataaacaacaagcaactagaggttgtcaaggcctttttagcacataatccaaaatggcgtaaagctgttttcatctcaccctataatagtcaaaattatgttgctcggcgtcttcttggtttgcaaacgcaaactgtggattccgctcagggtagtgagtatgattacgtcatctagctgctctgaagatttttaatcctgctgcaattcacgatgtgggtaatccaaaaggcatccgttgtgctacaacaccaataccatggttttgttatgatcgtgatcctattaataacaatgttagatgtctggattatgactatatggtacatggtcaaatgaatggtcttatgttattttggaactgtaatgtagacatgtacccagagttttcaattgtttgtagatttgatactcgcactcgctctaaattgtctttagaaggttgtaatggtggtgcattgtatgttaataaccatgctttccacacaccagcttatgatagaagagcttttgctaagcttaaacctatgccattcttttactatgatgatagtaattgtgaacttgttgatgggcaacctaattatgtaccacttaagtcaaatgtttgcataacaaaatgcaacattggtggtgctgtctgcaagaagcatgctgctctttacagagcgtatgttgaggattacaacatttttatgcaggctggttttacaatatggtgtcctcaaaactttgacacctatatgctttggcatggttttgttaatagcaaagcacttcagagtctagaaaatgtggcttttaatgtcgttaagaaaggtgccttcaccggtttaaaaggtgacttaccaactgctgttattgctgacaaaataatggtaagagatggacctactgacaaatgtatttttacaaataagactagtttacctacaaatgtagcttttgagttatatgcaaaacgcaaacttggactcacacctccattaacaatacttaggaatttaggtgttgtcgcaacatataagtttgtgttgtgggattatgaagctgaacgtcctttctcaaatttcactaagcaagtgtgttcctacactgatcttgatagtgaagttgtaacatgttttgataatagtattgctggctcttttgagcgttttactactacaagagatgcagtgcttatttctaataacgctgtgaaagggcttagtgccattaaattacaatatggccttttgaatgatctacctgtaagtactgttggaaataaacctgtcacatggtatatctatgtgcgcaagaatggtgagtacgtcgaacaaatcgatagttactatacacagggacgtacttttgaaaccttcaaacctcgtagtacaatggaagaagattttcttagtatggatactacactcttcatccaaaagtatggtcttgaggattatggttttgaacacgttgtatttggagatgtctctaaaactaccattggtggtatgcatcttcttatatcgcaagtgcgccttgcaaaaatgggtttgttttccgttcaagaatttatgaataattctgacagtacactgaaaagttgttgtattacatatgctgatgatccatcttctaagaatgtgtgcacttatatggacatactcttggacgattttgtgactatcattaagagcttagatcttaatgttgtgtccaaagttgtggatgtcattgtagattgtaaggcatggagatggatgttgtggtgtgagaattcacatattaaaaccttctatccacaactccaatctgctgaatggaatcccggctatagcatgcctacactgtacaaaatccagcgtatgtgtctcgaacggtgtaatctctacaattatggtgcacaagtgaaattacctgatggcattactactaatgtcgttaagtatactcagttgtgtcaataccttaacactactacattgtgtgtaccacacaaaatgcgtgtattgcatttaggagctgctggtgcatctggtgttgctcctggtagtactgtattaagaagatggttaccagatgatgccatattggttgataatgatttgagagattacgtttccgacgcagacttcagtgttacaggtgattgtactagtctttacatcgaagacaagtttgatttgctcgtctctgatttatatgatggctccacaaaatcaattgacggtgaaaacacgtcgaaagatggtttctttacttatattaatggtttcattaaagagaaactgtcacttggtggatctgttgccattaaaatcacggaatttagttggaataaagatttatatgaattgattcaaagatttgagtattggactgtgttttgtacaagtgttaacacgtcatcatcagaaggctttctgattggtattaactacttaggaccatactgtgacaaagcaatagtagatggaaatataatgcatgccaattatatattttggagaaactctacaattatggctctatcacataactcagtcctagacactcctaaattcaagtgtcgttgtaacaacgcacttattgttaatttaaaagaaaaagaattgaatgaaatggtcattggattactaaggaagggtaagttgctcattagaaataatggtaagttactaaactttggtaaccacttcgttaacacaccatgaaaaaatgctgtatttattacagttttaatcttactactaattggtagactccaattattagaaagactattacttaatcactctttcaatcttaaaactgtcaatgactttaatatcttatataggagtttagcagaaaccagattactaaaagtggtgcttcgagtaatctttctagtcttactaggattttgctgctacagattgttagtcacattaatgtaaggcaacccgatgtctaaaactggtttttccgaggaattactggtcatcgcgctgtctactcttgtacagaatggtaagcacgtgtaataggaggtacaagcaaccctattgcatattaggaagtttagatttgatttggcaatgctagatttagtaatttagagaagtttaaagatccgctacgacgagccaacaatggaagagctaacgtctggatctagtgattgtttaaaatgtaaaattgtttgaaaattttccttttgatagtgatacaaaaaa

SEQ ID NO: 93 - DNA, 922 bp, Coronavirus
tttgaacaaatttggtaaagctagactttactacgaaactctttcatatgaagagcaggatgcactttttgctttaacaaagagaaatgttttacccacaatgactcaaatgaatttgaaatacgctatttctggtaaggcaagagctcgtacagtaggaggagtttcacttctttctaccatgactacgagacaatatcatcagaagcatttgaagtcaattgctgcaacacgcaatgctactgtggtcattggttcaaccaagttttatggtggttgggacaatatgcttaaaaatttaatgcgtgatgttgataatggttgtttgatgggatgggactatcctaagtgtgaccgtgctttacctaatatgattagaatggcttctgccatgatattaggttctaagcatgttggttgttgtacacataatgataggttctaccgcctctccaatgagttagctcaagtactcacagaagttgtgcattgcacaggtggtttttattttaaacctggtggtacaactagcggtgatggtactacagcatatgctaactctgcttttaacatctttcaagctgtttctgctaatgttaataagcttttgggggttgattcaaacgcttgtaacaacgttacagtaaaatccatacaacgtaaaatttacgataattgttatcgtagtagcagcattgatgaagaatttgttgttgagtactttagttatttgagaaaacacttttctatgatgattttatctgatgatggagttgtgtgctacaacaaagattatgcggatttaggttatgtagctgacattaatgcttttaaagcaacactttattaccagaataacgtctttatgtccacttctaagtgttgggtagaaccagatcttagtgttggaccacatgaattt

SEQ ID NO: 94 - DNA, 919 bp, Coronavirus
atttaataagtttggaaaggcccgtctctattatgaaatgagtctagaagaacaggatcaactctttgagagtacaaagaagaatgtcctgcctactataactcaaatgaatttaaaatatgccatatccgcgaaaaatagagcgcgtacagtggcaggtgtgtctatcctttccactatgactaataggcaatttcatcagaagattcttaagtctatagtcaatactagaaatgctcctgtagttattgggacaaccaagttttatggcggttgggacaatatgttgaggaacctgattcaaggtgttgaagaccctattcttatggggtgggattatcctaagtgtgatagagcaatgccaaatttgctacgtataacagcatctttggtacttgctcgcaaacacactaattgttgtacttggtctgaacgcatttataggttgtataatgaatgcgctcaggttttatctgaaactgttttagctacaggtggtatttatgtaaaacctggtggcactagcagtggtgatgctactacagcttatgcaaacagtgtctttaatataatacaagccacatctgctaatgttgcgcgtcttttgagtgttataacgcgtgatattgtttatgatgacattaagagcttgcagtatgaattgtaccagcaggtttacaggcgagtcaatttcgacccagcctttgtagaaaagttttattcttacttatgtaagaatttctcattgatgatctttgctgacgacggtgttgtttgttataacaatacactagccaaacaaggtcttgtagcagacatttctggttttagagaaattctctactaccaaaataatgtttatatggctgattctaagtgttgggttgagcccgacttagaaaaaggtccacatgaattt

SEQ ID NO: 95 - DNA, 524 bp, Coronavirus
tgattgttttgtcaaacgtgttgattggtctattgtgtacccttttattgacaatgaggaaaagatcaataaagctggtcgcattgtgcaatcacatgtcatgaaagctgctctgaaaatttttaaccctgctgcaattcacgatgtgggcaatcccaaaggcatccgttgtgctacaacacctataccatggttctgttatgacagagatcctattaataacaatgttagatgtctggagtatgactatatggtacatggtcaaatgaatggtcttatgttattttggaactgcaatgtagacatgtacccagagttctcaattgtttgtagatttgatactcgcacgcgctctaaattgtctttagaaggttgtaatggtggtgcattgtatgttaataaccatgctttccacacaccagcttatgatagaagagcttttgctaagcttaaacctatgccattcttttactatgatgatagtaattgtgaacttgttgatggacaacctaattatgtgccac

SEQ ID NO: 96 - DNA, 524 bp, Coronavirus
tgactgttttgtcaaacgtgttgattggtcaattgtgtacccttttattgacaacgaagaaaagatcaataaagctggtcgcatagtacagtcacatgtcatgaaagctgctctgaaaatttttaatcctgctgcaattcacgatgtgggtaatcccaaaggcatccgttgtgctacaacaccaataccatggttttgttatgaccgtgatcctattaataacaatgttagatgtctggagtatgactatatggtacatggtcaaatgaatggtcttatgttgttttggaactgtaatgtggacatgtacccagagttctcaattgtttgtaggtttgatactcgaactcgctctaaattatctttagaaggttgtaatggtggtgcattgtatgtaaacaatcatgctttccacacaccagcttatgatagaagagcatttgctaagcttaaaccaatgccattcttctactatgatgatagtagttgtgaacttgttgatgggcaattaaactatgtaccac

SEQ ID NO: 97 - DNA, 524 bp, Coronavirus
tgattgttttgtcaaacgtgttgattggtcaattgtgtacccttttattgacaatgaagaaaagatcaataaagctggtcgcatagtgcagtcacatgtcatgaaagctgctctgaagatttttaatcctgctgcaattcacgatgtgggtaatcctaaaggaatccgttgtgctacaacacctataccatggttctgttatgaccgagatcctattaataacaatgttagatgtctggagtatgattacatggtacatggtcaaatgaatggtttaatgttgttttggaactgtaatgtagacatgtacccagagttctcaattgtttgtaggtttgatactcgcactcgatctaaattgtctttagaaggttgtaatggtggtgcattgtatgtcaataaccatgctttccacacaccagcttatgatagaagagcttttgctaagcttaaacctatgccattcttttactatgatgatagtaattgtgaacttgttgatggacaacctaattatgtaccac

SEQ ID NO: 98 - DNA, 524 bp, Coronavirus
tgattgttttgtcaaacgtgttgactggtcaattgtgtacccttttattgacaacgaagaaaagatcaataaagctggtcgcatagttcagtcacatgtcatgaaagctgctttgaagatttttaatcctgctgcaattcatgatgtgggtaatcccaaaggcatccgttgtgctacaacaccaataccatggttttgttatgatcgtgatcctattaataacaatgttagatgtctggagtatgactatatggtacatggtcaaatgaatggtcttatgttattttggaactgcaatgtagacatgtacccagagttttcaattgtttgtagatttgatactcgcactcgctctaaactgtctttagaaggttgtaatggtggtgcattgtatgtaaataaccatgctttccacacaccagcttatgatagaagagcttttgctaagcttaaacctatgccattcttttactatgatgatagtaattgtgaacttgttgatggacaacctaattatgtaccac

SEQ ID NO: 99 - DNA, 539 bp, Coronavirus
tgattgcttttgcaataatattaattggaatgtggagtatcccatcatttcaaatgagttaagtattaatacctcttgtagggtcttgcagcgtgtgattcttaaagctgccatgctctgcaacagatatactttgtgttatgatattggcaacccaaaagcgattgcctgtgtcaaagattttgattttaagttctatgatgcccaaccaattgttaagtctgttaagactcttttgtattcttttgaggcacataaggactcttttaaagacggtttgtgtatgttttggaactgtaatgtggataagtatccaccgaatgcagttgtatgtagatttgacactagagtgttgaataatttaaatcttcctggctgtaatggaggtagtttgtatgttaataaacatgcattccacactaaaccctttgctagggcagcctttgagcatttgaagcctatgccattcttctattattcagatacgccttgtgtgtatatggatggcatggatgctaagcaggttgattatgtacctt

SEQ ID NO: 100 - DNA, 539 bp, Coronavirus
tgattgcttttgtaagtctgttaattggaatttagaataccccattatttcaaatgaggtcagtgttaatacctcctgcaggttattgcagcgcgtaatgtttagggctgcgatgctatgcaacaggtatgatgtgtgttatgacattggcaaccctaaaggtcttgcctgtgtcaaaggttatgattttaagttttatgatgcctctcctgttgttaagtctgttaagcagtttgtttataaatacgaggcacataaagatcaatttttagatggtttatgtatgttttggaactgcaatgtggataagtatccagcgaatgcagttgtgtgtaggttcgacacgagagtgttaaacaaattaaatctccctggctgtaatggtggtagtctgtatgttaataaacatgcattccacaccagtccctttacgcgggcagccttcgagaatttaaagcctatgcctttcttttattattcagatacgccttgtgtgtatatggaaggcatggagtctaagcaggtcgattatgtcccat

SEQ ID NO: 101 - DNA, 539 bp, Coronavirus
tgattgcttttgtaaatctgtcaattggaatttagaataccccattattttaaatgaggtcagtgttaatacctcctgtaggttattgcagcgcgtaatgtttagggctgcgatgctatgcaataggtatgatgtgtgttatgacattggcaaccctaagggtcttgcctgtgtcaaaggatatgattttaagttttatgatgcctcccctgttgttaagtctgttaaacagtttgtttataagtacgaggcacataaagatcaatttttagatggtctatgtatgttctggaactgcaatgtggataagtatcccgcgaatgcagttgtgtgtaggtttgacacgcgcgtgttaaacaaattaaatctccctggctgtaatggtggtagtctgtatgttaacaaacatgcattccacactagcccttttacccgggctgcattcgagaatttgaagcctatgcctttcttctattattcagatacaccttgtgtgtatatggaaggcatggaatctaagcaggtagattatgtcccat

SEQ ID NO: 102 - DNA, 83 bp, Artificial Sequence
  PCR Internal Calibrant Standard Sequence
caagttttacggtggctggcataatatgttaaatttacagtgatgtagaaactccacaccttatgggttgggattatccaaaa

SEQ ID NO: 103 - DNA, 132 bp, Artificial Sequence
  PCR Internal Calibrant Standard Sequence
tgtttgttttggaattgtaacgttgatcgttacccagccaatgcaattgtgtgtaggttcaagagtcttgtcaaacttgaacttaccaggctgtgatggtggtagtttgtatgtgaataagcatgcattcca

SEQ ID NO: 104 - DNA, 265 bp, Artificial Sequence
  PCR Internal Calibrant Standard Sequence
tggaacaagcaagttttacggtggctggcataatatgttaaatttacagtgatgtagaaactccacaccttatgggttgggattatccaaaatgtgacagaggataaattcactgatggtgtttgtttgttttggaattgtaacgttgatcgttacccagccaatgcaattgtgtgtaggttcaagagtcttgtcaaacttgaacttaccaggctgtgatggtggtagtttgtatgtgaataagcatgcattccacactccagct

SEQ ID NO: 105 - DNA, 12 bp, Artificial Sequence
  Internal Mass Standard
cgtgcatggcgg

SEQ ID NO: 106 - RNA, 58 nt, Bacterial Ribosomal RNA
  misc_feature 1, 2, 3, 4, 5, 6, 7, 15, 22, 23, 24, 36, 37, 38, 41, 42,44, 56: n = A,T,C or G
nnnnnnnagaggacnggccagnnngaacgcggcggnnngcnnanacagcaagcgancg

SEQ ID NO: 107 - RNA, 157 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114,115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 108 - RNA, 91 nt, Bacterial Ribosomal RNA
  misc_feature 3, 7, 8, 19, 20, 22, 23, 24, 25, 26, 28, 29, 30, 33, 34,35, 36, 37, 38, 39, 40, 41, 44, 46, 48, 49, 50, 51, 52,53, 54, 59, 60, 61, 62, 63, 64, 65, 71, 72, 74, 75, 76,77, 78, 79, 80, 81, 82, 83, 84, 85, 86, 87: n = A,T,C or G
agnggcnnacggggagaanncnnnnnannnccnnnnnnnnnggnanannnnnnngaaannnnnnnaaaccnnannnnnnnnnnnnnnaaag

SEQ ID NO: 109 - RNA, 51 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51: n = A,T,C or G
nnnnnnnnnnnnnnnnnnnnnnnnnnnnnnnnnnnnnnnnnnnnnnnnnnn

SEQ ID NO: 110 - RNA, 184 nt, Bacterial Ribosomal RNA
  misc_feature 1, 2, 3, 4, 5, 6, 7, 8, 11, 12, 13, 14, 15, 16, 17, 18, 19,21, 22, 23, 24, 26, 29, 30, 34, 35, 40, 44, 45, 52, 54,55, 56, 59, 60, 61, 62, 66, 68, 69, 77, 78, 80, 81, 83,90, 93, 100, 105, 109, 128, 129, 134, 135, 136, 137, 143,144, 146, 149, 150, 154, 155, 156, 160, 162, 163, 170, 171,172,175, 178, 181, 182, 183, 184: n = A,T,C or G
nnnnnnnngannnnnnnnngnnnnanagnngggnnggaanggcnnaccaagncnnngannnnagcngnncgagaggnngnncngccacanggnacgaganacggnccanacccacgggaggcagcagnnggaannnncaaggnngnaanncgannnagcnannccgcggnnnganganggnnnn

SEQ ID NO: 111 - RNA, 2 nt, Bacterial Ribosomal RNA
  misc_feature 1, 2: n = A,T,C or G
nn

SEQ ID NO: 112 - RNA, 24 nt, Bacterial Ribosomal RNA
  misc_feature 2, 3, 8, 9, 10, 12, 13, 14, 15, 16, 17, 18, 19, 22: n = A,T,C or G
gnngaaannncnnnnnnnnganga

SEQ ID NO: 113 - RNA, 32 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32: n = A,T,C or G
nnnnnnnnnnnnnnnnnnnnnnnnnnnnnnnn

SEQ ID NO: 114 - RNA, 137 nt, Bacterial Ribosomal RNA
  misc_feature 4, 5, 7, 8, 9, 10, 11, 12, 13, 15, 16, 20, 21, 22, 27, 31,53, 57, 58, 61, 66, 67, 68, 73, 74, 76, 86, 88, 89, 90,92, 96, 99, 100, 101, 102, 103, 104, 105, 106, 108, 109,110, 111, 112, 114, 118, 119, 120, 121, 122, 123, 124, 127,131, 132, 133, 134, 135, 136, 137: n = A,T,C or G
gacnnannnnnnnannaagnnncggcnaacncggccagcagccgcggaaacgnaggnngcnagcgnnncggannangggcgaaagngnnngnaggnggnnnnnnnngnnnnngnaaannnnnnngcnaacnnnnnnn

SEQ ID NO: 115 - RNA, 1 nt, Bacterial Ribosomal RNA
  misc_feature 1: n = A,T,C or G
n

SEQ ID NO: 116 - RNA, 185 nt, Bacterial Ribosomal RNA
  misc_feature 1, 2, 4, 5, 6, 7, 8, 9, 10, 13, 14, 15, 16, 17, 18, 19, 21,25, 26, 27, 28, 29, 30, 33, 36, 37, 38, 39, 40, 41, 45,46, 47, 48, 53, 57, 60, 63, 67, 69, 70, 72, 74, 78, 82,83, 84, 93, 94, 95, 96, 97, 98, 102, 103, 104, 105, 106,107, 113, 115, 117, 118, 119, 120, 128, 132, 136, 158, 161,162, 168, 170, 171, 172, 173, 174, 175, 176, 177, 178, 180,181, 182, 184, 185: n = A,T,C or G
nncnnnnnnnacnnnnnnncngagnnnnnnagnggnnnnnngaannnnggagngggnaancgnagananngnangaanaccnnngcgaaggcnnnnnncggnnnnnnacgacncnannnncgaaagcngggnagcnaacaggaagaacccggagccangcnnaaacgngnnnnnnnnngnnngnn

SEQ ID NO: 117 - RNA, 37 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37: n = A,T,C or G
nnnnnnnnnnnnnnnnnnnnnnnnnnnnnnnnnnnnn

SEQ ID NO: 118 - RNA, 77 nt, Bacterial Ribosomal RNA
  misc_feature 1, 2, 3, 4, 5, 6, 7, 8, 9, 10, 11, 12, 14, 15, 16, 21, 22,23, 26, 27, 28, 29, 30, 45, 46, 53, 54, 55, 64, 75: n = A,T,C or G
nnnnnnnnnnnnannnaacgnnnaannnnnccgccggggagacgnncgcaagnnnaaaccaaangaagacggggncc

SEQ ID NO: 119 - RNA, 2 nt, Bacterial Ribosomal RNA
  misc_feature 1, 2: n = A,T,C or G
nn

SEQ ID NO: 120 - RNA, 80 nt, Bacterial Ribosomal RNA
  misc_feature 9, 11, 16, 21, 27, 29, 30, 36, 38, 46, 47, 48, 49, 50, 55,56, 57, 58, 59, 60, 61, 62, 63, 64, 65, 66, 67, 68, 69,72, 74, 75, 76, 77, 78, 79, 80: n = A,T,C or G
gcacaagcngnggagnagggnaacgangnnacgcgnanaaccaccnnnnngacannnnnnnnnnnnnnnganannnnnnn

SEQ ID NO: 121 - RNA, 100 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 122 - RNA, 80 nt, Bacterial Ribosomal RNA
  misc_feature 1, 2, 3, 4, 5, 6, 7, 14, 20, 31, 32, 36, 37, 49, 64, 65,66, 67, 68, 69, 70, 71, 72, 74, 76, 78, 80: n = A,T,C or G
nnnnnnnacagggngcaggngcgcagccggnnggannggggaagcccgnaacgagcgcaacccnnnnnnnnngncnancn

SEQ ID NO: 123 - RNA, 35 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35: n = A,T,C or G
nnnnnnnnnnnnnnnnnnnnnnnnnnnnnnnnnnn

SEQ ID NO: 124 - RNA, 24 nt, Bacterial Ribosomal RNA
  misc_feature 1, 3, 5, 9, 10, 11, 12, 13, 14, 15, 21, 22, 23: n = A,T,C or G
ngngnaccnnnnnnnacgccnnng

SEQ ID NO: 125 - RNA, 2 nt, Bacterial Ribosomal RNA
  misc_feature 1, 2: n = A,T,C or G
nn

SEQ ID NO: 126 - RNA, 107 nt, Bacterial Ribosomal RNA
  misc_feature 3, 4, 5, 15, 21, 29, 31, 35, 40, 42, 43, 44, 45, 50, 56,57, 65, 66, 67, 68, 69, 73, 74, 76, 78, 79, 82, 84, 85,86, 87, 89, 90, 92, 93, 94, 95, 96, 100, 103, 105, 106,107: n = A,T,C or G
aannnggaggaaggnggggangacgcaancncagncccangnnnngggcncacacnncacaaggnnnnnacanngngnngcnannnngnnannnnnagcnaancnnn

SEQ ID NO: 127 - RNA, 1 nt, Bacterial Ribosomal RNA
  misc_feature 1: n = A,T,C or G
n

SEQ ID NO: 128 - RNA, 136 nt, Bacterial Ribosomal RNA
  misc_feature 4, 5, 6, 7, 8, 9, 11, 12, 15, 20, 22, 23, 24, 25, 34, 35,36, 37, 39, 44, 45, 49, 59, 60, 61, 66, 68, 70, 71, 72,83, 88, 105, 106, 107, 110, 112, 113, 116, 117, 118, 119,120, 121, 122, 123, 124, 127, 128, 132, 133, 134, 135, 136: n = A,T,C or G
aaannnnnncnnagncggangnnnncgcaaccgnnnncngaagnnggancgcagaacgnnnacagnangnnncgggaaacgcncgggncgacacaccgcccgcannncangnnagnnnnnnnnnccnnaagnnnnn

SEQ ID NO: 129 - RNA, 84 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 130 - RNA, 46 nt, Bacterial Ribosomal RNA
  misc_feature 1, 2, 3, 4, 5, 7, 9, 12, 13, 14, 15, 16, 17, 18, 19, 20,21, 24, 28, 29, 30, 44: n = A,T,C or G
nnnnncnanggnnnnnnnnnngangggnnnaagcgaacaaggancc

SEQ ID NO: 131 - RNA, 1 nt, Bacterial Ribosomal RNA
  misc_feature 1: n = A,T,C or G
n

SEQ ID NO: 132 - RNA, 24 nt, Bacterial Ribosomal RNA
  misc_feature 2, 3, 4, 8, 9, 11, 14, 24: n = A,T,C or G
annngaanngnggnggacaccccn

SEQ ID NO: 133 - RNA, 35 nt, Bacterial Ribosomal RNA; identical to SEQ ID NO: 123
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35: n = A,T,C or G

SEQ ID NO: 134 - RNA, 97 nt, Bacterial Ribosomal RNA
  misc_feature 1, 2, 3, 4, 8, 9, 10, 11, 15, 17, 18, 19, 20, 21, 30, 34,35, 36, 37, 38, 39, 42, 46, 53, 55, 56, 57, 58, 59, 60,61, 63, 64, 66, 67, 68, 70, 71, 73, 74, 75, 78, 79, 82,83, 85, 86, 87, 88, 89, 90, 91, 92, 93, 95, 96, 97: n = A,T,C or G
nnnnaagnnnnaagngnnnnnggggagccnggcnnnnnnagncgangaaggangnnnnnnncnncnnnanncnnnggnnagnngnnnnnnnnncnnn

SEQ ID NO: 135 - RNA, 1 nt, Bacterial Ribosomal RNA
  misc_feature 1: n = A,T,C or G
n

SEQ ID NO: 136 - RNA, 31 nt, Bacterial Ribosomal RNA
  misc_feature 1, 3, 6, 7, 8, 10, 11, 27, 28, 29, 30, 31: n = A,T,C or G
nanccnnngnnccgaaggggaaacccnnnnn

SEQ ID NO: 137 - RNA, 202 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114,115, 116, 117, 118, 119, 120, 121, 122, 123, 124, 125, 126,127, 128, 129, 130, 131, 132, 133, 134, 135, 136, 137, 138,139, 140, 141, 142, 143, 144, 145, 146, 147, 148, 149, 150,151, 152, 153, 154, 155, 156, 157, 158, 159, 160, 161,162, 163, 164, 165, 166, 167, 168, 169, 170, 171, 172, 173,174, 175, 176, 177, 178, 179, 180, 181, 182, 183, 184, 185,186, 187, 188, 189, 190, 191, 192, 193, 194, 195, 196, 197,198, 199, 200, 201, 202: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 138 - RNA, 9 nt, Bacterial Ribosomal RNA
  misc_feature 1, 2, 3, 4, 5, 7, 8, 9: n = A,T,C or G
nnnnnannn

SEQ ID NO: 139 - RNA, 23 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23: n = A,T,C or G
nnnnnnnnnnnnnnnnnnnnnnn

SEQ ID NO: 140 - RNA, 51 nt, Bacterial Ribosomal RNA
  misc_feature 1, 2, 3, 4, 6, 7, 8, 11, 12, 13, 14, 15, 19, 27, 31, 32,33, 34, 35, 41, 47, 48, 51: n = A,T,C or G
nnnngnnnacnnnnngaangaaacacnagannnnngagaanagaaannaan

SEQ ID NO: 141 - RNA, 3 nt, Bacterial Ribosomal RNA
  misc_feature 1, 2, 3: n = A,T,C or G
nnn

SEQ ID NO: 142 - RNA, 24 nt, Bacterial Ribosomal RNA
  misc_feature 1, 2, 5, 7, 8, 9, 10, 14: n = A,T,C or G
nngancnnnngagnggcgagcgaa

SEQ ID NO: 143 - RNA, 1 nt, Bacterial Ribosomal RNA
  misc_feature 1: n = A,T,C or G
n

SEQ ID NO: 144 - RNA, 11 nt, Bacterial Ribosomal RNA
  misc_feature 1, 2, 4, 6, 7, 10: n = A,T,C or G
nngnannagnc

SEQ ID NO: 145 - RNA, 91 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 146 - RNA, 9 nt, Bacterial Ribosomal RNA
  misc_feature 1, 2, 3, 4, 5, 6, 7, 8, 9: n = A,T,C or G
nnnnnnnnn

SEQ ID NO: 147 - RNA, 1 nt, Bacterial Ribosomal RNA
  misc_feature 1: n = A,T,C or G
n

SEQ ID NO: 148 - RNA, 61 nt, Bacterial Ribosomal RNA
  misc_feature 1, 2, 3, 4, 6, 7, 8, 12, 13, 14, 15, 16, 19, 23, 24, 25,26, 27, 28, 29, 30, 31, 33, 34, 35, 38, 40, 42, 43, 46,49, 50, 51, 52, 56, 57, 58, 59, 60, 61: n = A,T,C or G
nnnnannngaannnnnggnaagnnnnnnnnnannnggnanannccngannnnaaannnnnn

SEQ ID NO: 149 - RNA, 2 nt, Bacterial Ribosomal RNA
  misc_feature 1, 2: n = A,T,C or G
nn

SEQ ID NO: 150 - RNA, 2 nt, Bacterial Ribosomal RNA
  misc_feature 1, 2: n = A,T,C or G
nn

SEQ ID NO: 151 - RNA, 1 nt, Bacterial Ribosomal RNA
  misc_feature 1: n = A,T,C or G
n

SEQ ID NO: 152 - RNA, 2 nt, Bacterial Ribosomal RNA
  misc_feature 1, 2: n = A,T,C or G
nn

SEQ ID NO: 153 - RNA, 16 nt, Bacterial Ribosomal RNA
  misc_feature 1, 2, 3, 4, 5, 6, 7, 8, 9, 10, 11, 12, 13, 14, 15, 16: n = A,T,C or G
nnnnnnnnnnnnnnnn

SEQ ID NO: 154 - RNA, 79 nt, Bacterial Ribosomal RNA
  misc_feature 1, 5, 6, 7, 9, 10, 11, 12, 14, 17, 19, 20, 22, 23, 24, 25,27, 28, 32, 33, 34, 36, 37, 38, 39, 45, 46, 47, 48, 49,50, 54, 61, 62, 63, 64, 65, 66, 67, 72, 76, 78: n = A,T,C or G
nagannncnnnncncgngnnannnngnngaannngnnnngaccannnnnnaagncaaaacnnnnnnngaccnaagngna

SEQ ID NO: 155 - RNA, 2 nt, Bacterial Ribosomal RNA
  misc_feature 1, 2: n = A,T,C or G
nn

SEQ ID NO: 156 - RNA, 32 nt, Bacterial Ribosomal RNA
  misc_feature 1, 6, 10, 19, 25, 30, 31, 32: n = A,T,C or G
nagacngganggaaaaggngaaagnacccnnn

SEQ ID NO: 157 - RNA, 1 nt, Bacterial Ribosomal RNA
  misc_feature 1: n = A,T,C or G
n

SEQ ID NO: 158 - RNA, 48 nt, Bacterial Ribosomal RNA
  misc_feature 1, 3, 13, 16, 17, 26, 27, 28, 29, 30, 32, 34, 37, 38, 39,41, 42, 43, 46, 47, 48: n = A,T,C or G
nangggaggaaanagnnccgaaaccnnnnncnanaannngnnnagnnn

SEQ ID NO: 159 - RNA, 33 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33: n = A,T,C or G
nnnnnnnnnnnnnnnnnnnnnnnnnnnnnnnnn

SEQ ID NO: 160 - RNA, 49 nt, Bacterial Ribosomal RNA
  misc_feature 1, 2, 3, 6, 7, 11, 15, 17, 18, 21, 22, 23, 25, 27, 30, 31,32, 33, 34, 35, 36, 37, 38, 39, 42, 45, 48, 49: n = A,T,C or G
nnnganngcgnccgnannagnnncngngannnnnnnnnngcnagnaann

SEQ ID NO: 161 - RNA, 5 nt, Bacterial Ribosomal RNA
  misc_feature 1, 2, 3, 4, 5: n = A,T,C or G
nnnnn

SEQ ID NO: 162 - RNA, 208 nt, Bacterial Ribosomal RNA
  misc_feature 1, 2, 3, 4, 5, 7, 10, 13, 16, 21, 26, 27, 28, 31, 32, 34,38, 39, 40, 43, 44, 45, 46, 47, 49, 50, 51, 52, 57, 62,64, 65, 66, 70, 73, 74, 75, 78, 79, 84, 89, 90, 91, 92,93, 97, 99, 100, 101, 102, 103, 108, 115, 116, 117, 118,119, 120, 121, 122, 129, 130, 131, 132, 133, 134, 140, 141, 144,145, 146, 148, 151, 156, 157, 159, 162, 164, 168, 169, 170,172, 173, 182, 183, 189, 190, 191, 192, 196, 197, 198, 199,202, 203, 204, 205, 206, 207, 208: n = A,T,C or G
nnnnngnagncgnagngaaancgagnnnaanngngggnnnagnnnnngnnnnagacncgaancnnnggancannnagnncaggngaagnnnnngaanannnnnggggnccgaacnnnnnnnnggaaaannnnnnggaagnnggnnngnggngaaanncnaancnaacnnngnnaagcggccnncgaaannnnaggnnnngcnnnnnnn

SEQ ID NO: 163 - RNA, 3 nt, Bacterial Ribosomal RNA
  misc_feature 1, 2, 3: n = A,T,C or G
nnn

SEQ ID NO: 164 - RNA, 40 nt, Bacterial Ribosomal RNA
  misc_feature 1, 2, 3, 4, 5, 6, 7, 10, 21, 22, 23, 24, 25, 26, 27, 28,29, 30, 33, 34, 35, 36, 37, 38, 39, 40: n = A,T,C or G
nnnnnnnggnggagagcacgnnnnnnnnnnggnnnnnnnn

SEQ ID NO: 165 - RNA, 1 nt, Bacterial Ribosomal RNA
  misc_feature 1: n = A,T,C or G
n

SEQ ID NO: 166 - RNA, 33 nt, Bacterial Ribosomal RNA
  misc_feature 1, 2, 3, 4, 7, 8, 10, 11, 12, 13, 14, 15, 16, 17, 22, 27,30, 31, 32, 33: n = A,T,C or G
nnnnacnnannnnnnnnaaacncgaanccnnnn

SEQ ID NO: 167 - RNA, 3 nt, Bacterial Ribosomal RNA
  misc_feature 1, 2, 3: n = A,T,C or G
nnn

SEQ ID NO: 168 - RNA, 1 nt, Bacterial Ribosomal RNA
  misc_feature 1: n = A,T,C or G
n

SEQ ID NO: 169 - RNA, 5 nt, Bacterial Ribosomal RNA
  misc_feature 1, 2, 3, 4, 5: n = A,T,C or G
nnnnn

SEQ ID NO: 170 - RNA, 75 nt, Bacterial Ribosomal RNA
  misc_feature 1, 2, 3, 4, 5, 6, 8, 11, 12, 14, 15, 17, 18, 19, 21, 23,25, 28, 29, 30, 32, 33, 34, 36, 37, 39, 44, 49, 56, 58,59, 61, 62, 63, 68, 72, 75: n = A,T,C or G
nnnnnngnagnnanncnnngngngnaannncnnngnnanagggnaacancccagancnncnnnaaggncccnaan

SEQ ID NO: 171 - RNA, 1 nt, Bacterial Ribosomal RNA
  misc_feature 1: n = A,T,C or G
n

SEQ ID NO: 172 - RNA, 139 nt, Bacterial Ribosomal RNA
  misc_feature 1, 2, 3, 4, 5, 6, 12, 16, 19, 22, 23, 24, 25, 26, 27, 29,30, 32, 36, 37, 38, 43, 51, 59, 61, 62, 68, 69, 75, 82,83, 85, 88, 89, 90, 91, 92, 93, 94, 99, 102, 103, 105, 107,111, 115, 116, 117, 118, 119, 120, 121, 122, 128, 129, 130,131, 132, 133, 135, 136, 137, 138, 139: n = A,T,C or G
nnnnnnaagggnaaanganggnnnnnncnnanacannnaggangggcagangcagccancnnaaaganngcgaanagccacnncnagnnnnnnngcgcngannanancggncaannnnnnnnccgaannnnnngnnnnn

SEQ ID NO: 173 - RNA, 127 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114,115, 116, 117, 118, 119, 120, 121, 122, 123, 124, 125, 126,127: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 174 - RNA, 23 nt, Bacterial Ribosomal RNA
  misc_feature 1, 2, 3, 4, 5, 11, 12, 18, 19, 20, 21, 22, 23: n = A,T,C or G
nnnnngggagnngagcgnnnnnn

SEQ ID NO: 175 - RNA, 103 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 176 - RNA, 62 nt, Bacterial Ribosomal RNA
  misc_feature 1, 2, 3, 4, 5, 6, 11, 12, 13, 14, 15, 16, 17, 19, 20, 22,23, 24, 25, 26, 27, 28, 32, 33, 34, 35, 36, 37, 38, 39,40, 44, 46, 49, 50, 52, 53, 55, 59: n = A,T,C or G
nnnnnngaagnnnnnnngnnannnnnnnggannnnnnnnnaggngnagnngnnanagancga

SEQ ID NO: 177 - RNA, 3 nt, Bacterial Ribosomal RNA
  misc_feature 1, 2, 3: n = A,T,C or G
nnn

SEQ ID NO: 178 - RNA, 88 nt, Bacterial Ribosomal RNA
  misc_feature 1, 2, 3, 4, 5, 9, 11, 12, 14, 15, 16, 17, 18, 20, 24, 26,27, 28, 30, 35, 38, 39, 40, 41, 42, 43, 44, 46, 48, 49,50, 52, 53, 54, 55, 56, 57, 61, 66, 67, 68, 74, 75, 79,81, 84, 86, 88: n = A,T,C or G
nnnnnggananncnnnnncnccgnannncnaaggnccnnnnnnnangnnncnnnnnngggnagcgnnnccaagnngagncnganangn

SEQ ID NO: 179 - RNA, 1 nt, Bacterial Ribosomal RNA
  misc_feature 1: n = A,T,C or G
n

SEQ ID NO: 180 - RNA, 33 nt, Bacterial Ribosomal RNA
  misc_feature 3, 4, 9, 10, 12, 13, 14, 17, 18, 23, 24, 25, 28, 29, 30,31, 32, 33: n = A,T,C or G
agnngaggnnannnggnnaaccnnnacnnnnnn

SEQ ID NO: 181 - RNA, 1 nt, Bacterial Ribosomal RNA
  misc_feature 1: n = A,T,C or G
n

SEQ ID NO: 182 - RNA, 1 nt, Bacterial Ribosomal RNA
  misc_feature 1: n = A,T,C or G
n

SEQ ID NO: 183 - RNA, 119 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107, 108, 109, 110, 111, 112, 113, 114,115, 116, 117, 118, 119: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 184 - RNA, 10 nt, Bacterial Ribosomal RNA
  misc_feature 1, 2, 3, 8, 9, 10: n = A,T,C or G
nnngacgnnn

SEQ ID NO: 185 - RNA, 2 nt, Bacterial Ribosomal RNA
  misc_feature 1, 2: n = A,T,C or G
nn

SEQ ID NO: 186 - RNA, 10 nt, Bacterial Ribosomal RNA
  misc_feature 1, 3, 4, 5, 6, 7, 8, 9, 10: n = A,T,C or G
ngnnnnnnnn

SEQ ID NO: 187 - RNA, 2 nt, Bacterial Ribosomal RNA
  misc_feature 1, 2: n = A,T,C or G
nn

SEQ ID NO: 188 - RNA, 7 nt, Bacterial Ribosomal RNA
  misc_feature 1, 2, 3, 4, 5, 6, 7: n = A,T,C or G
nnnnnnn

SEQ ID NO: 189 - RNA, 3 nt, Bacterial Ribosomal RNA
  misc_feature 1, 2, 3: n = A,T,C or G
nnn

SEQ ID NO: 190 - RNA, 4 nt, Bacterial Ribosomal RNA
  misc_feature 1, 4: n = A,T,C or G
nggn

SEQ ID NO: 191 - RNA, 4 nt, Bacterial Ribosomal RNA
  misc_feature 1, 2, 3, 4: n = A,T,C or G
nnnn

SEQ ID NO: 192 - RNA, 6 nt, Bacterial Ribosomal RNA
  misc_feature 1, 2, 3, 4, 5, 6: n = A,T,C or G
nnnnnn

SEQ ID NO: 193 - RNA, 107 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,60, 61, 62, 63, 64, 65, 66, 67, 68, 69, 70, 71, 72, 73, 74, 75,76, 77, 78, 79, 80, 81, 82, 83, 84, 85, 86, 87, 88, 89,90, 91, 92, 93, 94, 95, 96, 97, 98, 99, 100, 101, 102, 103,104, 105, 106, 107: n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 194 - RNA, 4 nt, Bacterial Ribosomal RNA
  misc_feature 1, 2, 3, 4: n = A,T,C or G
nnnn

SEQ ID NO: 195 - RNA, 2 nt, Bacterial Ribosomal RNA
  misc_feature 1, 2: n = A,T,C or G
nn

SEQ ID NO: 196 - RNA, 5 nt, Bacterial Ribosomal RNA
  misc_feature 1, 2, 3, 4, 5: n = A,T,C or G
nnnnn

SEQ ID NO: 197 - RNA, 4 nt, Bacterial Ribosomal RNA
  misc_feature 1, 2, 3, 4: n = A,T,C or G
nnnn

SEQ ID NO: 198 - RNA, 13 nt, Bacterial Ribosomal RNA
  misc_feature 1, 2, 3, 4, 6, 7, 13: n = A,T,C or G
nnnncnngaaaan

SEQ ID NO: 199 - RNA, 17 nt, Bacterial Ribosomal RNA
  misc_feature 1, 2, 3, 4, 5, 6, 7, 8, 9, 10, 11, 12, 13, 14, 15, 16, 17: n = A,T,C or G
nnnnnnnnnnnnnnnnn

SEQ ID NO: 200 - RNA, 116 nt, Bacterial Ribosomal RNA
  misc_feature 1, 2, 3, 4, 5, 6, 7, 8, 9, 10, 11, 12, 18, 19, 33, 35, 36,37, 38, 40, 41, 45, 47, 48, 50, 51, 55, 57, 58, 59, 61,62, 63, 64, 67, 68, 69, 70, 71, 72, 73, 74, 82, 83, 89,90, 91, 92, 93, 98, 103, 105, 110, 111, 112, 113, 115, 116: n = A,T,C or G
nnnnnnnnnnnncgaccnnaaaccgacacaggngnnnngnngagnanncnnaggngnnngnnnnaannnnnnnnaaggaacnngcaaannnnnccganccggnanaaggnnnncnn

SEQ ID NO: 201 - RNA, 53 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53: n = A,T,C or G
nnnnnnnnnnnnnnnnnnnnnnnnnnnnnnnnnnnnnnnnnnnnnnnnnnnnn

SEQ ID NO: 202 - RNA, 105 nt, Bacterial Ribosomal RNA
  misc_feature 1, 2, 4, 5, 6, 7, 9, 10, 11, 13, 14, 15, 17, 18, 19, 20,21, 22, 23, 25, 30, 31, 32, 44, 45, 46, 47, 48, 51, 54,55, 56, 58, 62, 63, 66, 70, 71, 72, 73, 74, 78, 89, 90,98, 99, 101, 102, 103, 104, 105: n = A,T,C or G
nngnnnnannnannngnnnnnnncnacgannnaaaaacaccagnnnnngcnaannngnaagnngangaannnnngacnccgcccgggcnngaaggaanngnnnnn

SEQ ID NO: 203 - RNA, 4 nt, Bacterial Ribosomal RNA
  misc_feature 1, 2, 3, 4: n = A,T,C or G
nnnn

SEQ ID NO: 204 - RNA, 7 nt, Bacterial Ribosomal RNA
  misc_feature 2, 3, 4, 5, 7: n = A,T,C or G
gnnnngn

SEQ ID NO: 205 - RNA, 6 nt, Bacterial Ribosomal RNA
  misc_feature 1, 2, 3, 4, 5, 6: n = A,T,C or G
nnnnnn

SEQ ID NO: 206 - RNA, 164 nt, Bacterial Ribosomal RNA
  misc_feature 1, 2, 3, 4, 5, 7, 8, 9, 16, 17, 19, 28, 29, 38, 39, 69, 77,80, 82, 85, 88, 89, 90, 91, 92, 93, 94, 95, 100, 101, 102,103, 104, 105, 106, 107, 108, 110, 112, 114, 118, 119, 120,122, 123, 124, 125, 126, 128, 135, 136, 137, 138, 139,141, 145, 146, 147, 148, 149, 164: n = A,T,C or G
nnnnnannnaagcccnngnaacggcggnngaacaaacnnccaaggagcgaaaccgcgggaagccgaccngcacgaanggngnaangannnnnnnncgccnnnnnnnnncncngngaannnannnnngnaagagcnnnnncncgcnnnnngacggaaagaccccn

SEQ ID NO: 207 - RNA, 1 nt, Bacterial Ribosomal RNA
  misc_feature 1: n = A,T,C or G
n

SEQ ID NO: 208 - RNA, 118 nt, Bacterial Ribosomal RNA
  misc_feature 1, 3, 7, 8, 10, 11, 12, 13, 14, 15, 17, 19, 20, 21, 22, 23,24, 25, 26, 27, 28, 29, 30, 31, 32, 33, 35, 36, 39, 44,49, 51, 52, 53, 56, 57, 58, 59, 60, 61, 62, 63, 66, 67,70, 71, 72, 73, 74, 75, 76, 81, 83, 84, 85, 86, 87, 89,90, 94, 97, 99, 100, 101, 102, 103, 104, 105, 106, 107, 108,109, 110, 111, 112, 117, 118: n = A,T,C or G
nancacnnannnnnnangnnnnnnnnnnnnnnngnnagnaaggnggagncnnngannnnnnnncgnnagnnnnnnnggagncnnnnngnnaacnacncnnnnnnnnnnnnnncaacnn

SEQ ID NO: 209 - RNA, 1 nt, Bacterial Ribosomal RNA
  misc_feature 1: n = A,T,C or G
n

SEQ ID NO: 210 - RNA, 11 nt, Bacterial Ribosomal RNA
  misc_feature 1, 2, 3, 4, 5, 6, 7, 8, 10: n = A,T,C or G
nnnnnnnnanc

SEQ ID NO: 211 - RNA, 2 nt, Bacterial Ribosomal RNA
  misc_feature 1, 2: n = A,T,C or G
nn

SEQ ID NO: 212 - RNA, 500 nt, Bacterial Ribosomal RNA
  misc_feature 1, 2, 3, 4, 5, 6, 7, 8, 13, 15, 16, 17, 19, 20, 24, 27, 37,38, 43, 47, 48, 58, 60, 61, 63, 68, 69, 70, 72, 74, 75,76, 77, 80, 81, 84, 85, 88, 89, 90, 91, 92, 93, 94, 95,98, 99, 102, 103, 105, 107, 111, 112, 113, 115, 116, 117,121, 122, 125, 126, 127, 128, 131, 132, 133, 134, 142, 143, 144,145, 152, 153, 156, 157, 158, 167, 170, 171, 172, 173, 174,175, 181, 183, 184, 185, 189, 201, 204, 206, 219, 221, 222,223, 224, 233, 236, 244, 245, 246, 247, 264, 266, 276,279, 280, 285, 291, 292, 301, 302, 307, 310, 314, 322, 324,338, 346, 348, 349, 351, 353, 355, 357, 358, 359, 362, 363,364, 367, 368, 369, 371, 372, 373, 375, 376, 378, 394, 395,396, 398, 401, 402, 404, 406, 411, 412, 413, 414, 415,418, 419, 420, 425, 426, 427, 431, 432, 435, 437, 438, 443,444, 445, 446, 449, 450, 451, 452, 457, 458, 464, 472, 473,474, 478, 480, 481, 482, 484, 485, 486, 487, 491, 492, 495,496, 497, 499: n = A,T,C or G
nnnnnnnngacangnnngnngggnagnacggggcggnnccccnaaanngaacggaggngnncnaaggnnncnannnnggnnggnnacnnnnnnnnagnnaanngnanaagnnngnnnacgnnagnnnnacnnnncgagcagnnnncgaaagnnggnnnaggaccggnggnnnnnnggaagngnnncgcnaacggaaaaagnacncnggggaaacagggnannnncccaagagncanacgacggnnnngggcacccgagcggccncncaccgggggnagnnggccnaagggnnggcgcgccnnaaagnggnacgngagcgggnanaacgcggagacagnggcccacngnngngngngnnngannngannngnnngnncnagacgagaggaccggnnngnacnnancncgggnnnnnggnnngccannngcanngcngnnagcannnnggnnnngaaanngcgaangcacaagnnngaancnnncnnnnagannagnnncnc

SEQ ID NO: 213 - RNA, 18 nt, Bacterial Ribosomal RNA
  misc_feature 1, 2, 3, 4, 5, 6, 7, 8, 9, 10, 11, 12, 13, 14, 15, 16, 17,18: n = A,T,C or G
nnnnnnnnnnnnnnnnnn

SEQ ID NO: 214 - RNA, 1 nt, Bacterial Ribosomal RNA
  misc_feature 1: n = A,T,C or G
n

SEQ ID NO: 215 - RNA, 2 nt, Bacterial Ribosomal RNA
  misc_feature 1, 2: n = A,T,C or G
nn

SEQ ID NO: 216 - RNA, 74 nt, Bacterial Ribosomal RNA
  misc_feature 3, 4, 5, 6, 7, 8, 9, 10, 11, 15, 16, 18, 19, 20, 21, 23,29, 30, 31, 33, 34, 35, 40, 41, 42, 43, 45, 46, 48, 49,50, 51, 52, 53, 56, 57, 58, 61, 62, 63, 68, 69, 70, 71,73, 74: n = A,T,C or G
agnnnnnnnnnagannannnngngaaggnnngnnngaagnnnngnnannnnnnagnnnacnnnacaannnncnn

SEQ ID NO: 217 - RNA, 1 nt, Bacterial Ribosomal RNA
  misc_feature 1: n = A,T,C or G
n

SEQ ID NO: 218 - RNA, 8 nt, Bacterial Ribosomal RNA
  misc_feature 1, 3, 5, 6, 7, 8: n = A,T,C or G
ngncnnnn

SEQ ID NO: 219 - RNA, 2 nt, Bacterial Ribosomal RNA
  misc_feature 1, 2: n = A,T,C or G
nn

SEQ ID NO: 220 - RNA, 366 nt, Bacterial Ribosomal RNA
  misc_feature 1, 2, 3, 4, 5, 6, 7, 8, 9, 10, 11, 12, 13, 14, 15, 16, 17,18, 19, 20, 21, 22, 23, 24, 25, 26, 27, 28, 29, 30, 31,32, 33, 34, 35, 36, 37, 38, 39, 40, 41, 42, 43, 44, 45,46, 47, 48, 49, 50, 51, 52, 53, 54, 55, 56, 57, 58, 59,73, 76, 77, 78, 80, 81, 84, 85, 86, 88, 89, 90, 92, 95, 96, 97,99, 100, 101, 102, 103, 104, 105, 107, 108, 110, 111, 112,113, 114, 118, 121, 123, 130, 132, 133, 134, 135, 142, 143,144, 145, 146, 147, 148, 149, 150, 151, 152, 153, 154,155, 156, 157, 158, 159, 160, 161, 162, 163, 164, 167, 174,177, 180, 181, 182, 183, 190, 191, 197, 198, 199, 200, 201,202, 203, 204, 206, 207, 209, 210, 211, 212, 213, 214, 215,216, 217, 218, 220, 221, 224, 231, 232, 233, 234, 236,243, 244, 245, 246, 247, 248, 249, 250, 251, 253, 254, 255,256, 257, 258, 259, 260, 261, 262, 263, 264, 265, 266, 267,269, 270, 272, 273, 274, 275, 276, 277, 278, 279, 280, 281,282, 283, 284, 285, 286, 288, 289, 290, 291, 294, 298,299, 300, 301, 302, 303, 304, 306, 307, 309, 310, 311, 312,313, 314, 315, 318, 322, 323, 324, 327, 328, 329, 330, 331,332, 334, 335, 336, 343, 349, 351, 352, 353, 354, 355, 356,357, 358, 359, 360, 361, 362, 363, 364, 365, 366: n = A,T,C or G
nnnnnnnnnnnnnnnnnnnnnnnnnnnnnnnnnnnnnnnnnnnnnnnnnnnnnnnnnnngaggaaaagccggnccnnnanncannngnnngnaannncnnnnnnngnnannnnngacnagncnacagagngnnnncccgccnnnnnnnnnnnnnnnnnnnnnnnggnaaggggnaanggnnnngaagagnncaccgnnnnnnnngnnannnnnnnnnncnnggnaaacccnnnngnagcaagnnnnnnnnngnnnnnnnnnnnnnnngnncnnnnnnnnnnnnnnnannnngcngagnnnnnnngnnannnnnnnccnagannnagnnnnnncnnnacagaanccggcnannnnnnnnnnnnnnnn

SEQ ID NO: 221 - DNA, 9 bp, Double stranded nucleic acid
tacgtacgt

SEQ ID NO: 222 - DNA, 9 bp, Double stranded nucleic acid
atgcatgca

SEQ ID NO: 223 - DNA, 18 bp, Forward Primer
aagttttatggcggctgg

SEQ ID NO: 224 - DNA, 20 bp, Complement of reverse primer
atgggttgggactatcctaa

SEQ ID NO: 225 - DNA, 25 bp, Forward primer
gtttgttttggaattgtaatgttga

SEQ ID NO: 226 - DNA, 24 bp, Complement of reverse primer
tgtatgttaataagcatgcattcc

What is claimed is:

1. A multiplex polymerase chain reaction method for identifying a coronavirus, comprising:
    a) providing a sample suspected of comprising one or more coronavirus family members, wherein the identity of said coronavirus family members is unknown;
    b) providing coronavirus RNA from said sample, wherein the identity of the coronavirus source of said coronavirus RNA is unknown;
    c) providing corresponding DNA from said RNA wherein said DNA comprises sequences encoding at least a portion of a nsp11 gene and at least a portion of a RdRp gene;
    d) amplifying said DNA to produce first and second amplification products using two or more oligonucleotide primer pairs, wherein said first amplification product comprises sequences encoding at least a portion of said nsp11 gene and said second amplification product comprises sequences encoding at least a portion of said RdRp gene;
    e) determining the base compositions of said first and second amplification products by mass spectrometry without sequencing said first and second amplification products, wherein said base compositions identifies the number of A residues, C residues, T residues, G residues, U residues, analogs thereof and mass tag residues thereof in said first and second amplification products;
    f) comparing said base compositions of said first and second amplification products to calculated or measured base compositions of corresponding amplification products of one or more known coronaviruses present in a database with the proviso that sequencing of said first and second amplification products is not used to identify said coronavirus, wherein a match between said determined base compositions and said calculated or measured base composition in said database identifies the identity of said one or more coronavirus family members in said sample; and
    g) determining the identity of said one or more coronavirus family members by identifying a match between said determined based compositions and said calculated or measured base composition in said database.

2. The method of claim 1, wherein said two or more oligonucleotide primer pairs comprise primer pair SEQ ID NO: 5 and SEQ ID NO: 6, and at least one additional primer pair selected from the group consisting of SEQ ID NO: 7 and SEQ ID NO: 8, SEQ ID NO: 9 and SEQ ID NO: 8, SEQ ID NO: 9 and SEQ ID NO: 10, SEQ ID NO: 11 and SEQ ID NO: 8, and SEQ ID NO: 11 and SEQ ID NO: 10.

3. The method of claim 1, wherein said amplifying is carried out in a single reaction well.

4. The method of claim 1, wherein said amplifying is carried out in primer pair specific reaction wells.

5. The method of claim 1, wherein one or more coronavirus family members are identified in the sample, the identified family members comprising one or more of Canine coronavirus, Feline coronavirus, Human coronavirus 229E, Human coronavirus OC43, Porcine epidemic diarrhea virus, Transmissible gastroenteritis virus, Bovine coronavirus, Murine hepatitis virus, Porcine hemagglutinating encephalomyelitis virus, Rat coronavirus, Turkey coronavirus, Avian infectious bronchitis virus, and SARS coronavirus.

6. The method of claim 1, wherein said mass spectrometry comprises ESI-TOF mass spectrometry.

7. A multiplex polymerase chain reaction method for identifying a coronavirus, comprising:
    a) providing a sample suspected of comprising one or more coronavirus family members, wherein the identity of said coronavirus family members is unknown;
    b) providing coronavirus RNA from said sample, wherein the identity of the coronavirus source of said coronavirus RNA is unknown;
    c) providing corresponding DNA from said RNA wherein said DNA comprises sequences encoding at least a portion of a nsp11 gene and at least a portion of a RdRp gene;
    d) amplifying said DNA with a first primer pair to produce a first amplification product that comprises sequences encoding at least a portion of said nsp11 gene, wherein said first primer pair comprises: i) a forward primer with at least 70% sequence identity with SEQ ID NO: 5, and ii) a reverse primer with at least 70% identity with SEQ ID NO: 6;
    e) amplifying said DNA with a second primer pair to produce a second amplification product that comprises sequences encoding at least a portion of said RdRp gene;
    f) determining the base compositions of said first and second amplification products by mass spectrometry without sequencing said first and second amplification products, wherein said base compositions identifies the number of A residues, C residues, T residues, G residues, U residues, analogs thereof and mass tag residues thereof in said first and second amplification products;
    g) comparing said base compositions of said first and second amplification products to calculated or measured base compositions of corresponding amplification products of one or more known coronaviruses present in a database with the proviso that sequencing of said first and second amplification products is not used to identify said coronavirus, wherein a match between said determined base compositions and said calculated or measured base composition in said database identifies the identity of said one or more coronavirus family members in said sample; and
    h) determining the identity of said one or more coronavirus family members by identifying a match between said determined based compositions and said calculated or measured base composition in said database.

* * * * *